United States Patent 11,098,302 (IDENTIFICATION OF POLYNUCLEOTIDES ASSOCIATED WITH A SAMPLE) - sequence listing, part 147

SEQ ID NO: 563648 - DNA, 496 bp, Homo sapiens
  misc_feature: HIJSMM301AQDWC.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttcccg

SEQ ID NO: 563649 - DNA, 520 bp, Homo sapiens
  misc_feature: HIJSMM301EDA5J.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccgccct

SEQ ID NO: 563650 - DNA, 499 bp, Homo sapiens; identical to SEQ ID NO: 538643
  misc_feature: HIJSMM301A9HZ7.48.1.A01.1.454.light.4.raw

SEQ ID NO: 563651 - DNA, 520 bp, Homo sapiens; identical to SEQ ID NO: 539176
  misc_feature: HIJSMM301EAOML.27.23.C01.1.454.light.4.raw

SEQ ID NO: 563652 - DNA, 491 bp, Homo sapiens; identical to SEQ ID NO: 535294
  misc_feature: HIJSMM301C1CI9.16.68.G02.1.454.light.4.raw

SEQ ID NO: 563653 - DNA, 505 bp, Homo sapiens; identical to SEQ ID NO: 551816
  misc_feature: HIJSMM301CS35C.18.78.H01.1.454.light.4.raw

SEQ ID NO: 563654 - DNA, 492 bp, Homo sapiens
  misc_feature: HIJSMM301ENSSB.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggttattactgcatgcaagctctacaaactccctcaacgttcggcggagggaccaaggtggagatcaaacgaactgtggctgcaccatctgtcttcta

SEQ ID NO: 563655 - DNA, 488 bp, Homo sapiens
  misc_feature: HIJSMM301AZ2MS.15.49.E05.1.454.light.4.raw
  modified_base (202)..(202): a, c, t, g, unknown or other
tctacgtagccacgaccggtgctcgatttagagcgactagcaacacacaaagggggaggaactgctcagttaggacccagacggaacctatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaggaccaaggtggaaatcaaacgaactagtggctgcaccat

SEQ ID NO: 563656 - DNA, 504 bp, Homo sapiens; identical to SEQ ID NO: 537401
  misc_feature: HIJSMM301ADMUS.51.23.C01.1.454.light.4.raw

SEQ ID NO: 563657 - DNA, 489 bp, Homo sapiens; identical to SEQ ID NO: 535139
  misc_feature: HIJSMM301DN94N.14.55.E11.1.454.light.4.raw

SEQ ID NO: 563658 - DNA, 495 bp, Homo sapiens; identical to SEQ ID NO: 536316
  misc_feature: HIJSMM301CW1MP.40.23.C01.1.454.light.4.raw

SEQ ID NO: 563659 - DNA, 494 bp, Homo sapiens; identical to SEQ ID NO: 534994
  misc_feature: HIJSMM301CINYK.27.78.H01.1.454.light.4.raw

SEQ ID NO: 563660 - DNA, 486 bp, Homo sapiens; identical to SEQ ID NO: 535043
  misc_feature: HIJSMM301APSNM.46.35.D02.1.454.light.4.raw

SEQ ID NO: 563661 - DNA, 493 bp, Homo sapiens
  misc_feature: HIJSMM301AE8UT.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcggaccgacgagtggatgtcaaacgaactacgt

SEQ ID NO: 563662 - DNA, 489 bp, Homo sapiens
  misc_feature: HIJSMM301CKIDU.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctggaccaaa

SEQ ID NO: 563663 - DNA, 459 bp, Homo sapiens
  misc_feature: HIJSMM301BKZRR.11.86.H09.1.454.light.4.raw
cgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 563664 - DNA, 502 bp, Homo sapiens; identical to SEQ ID NO: 541971
  misc_feature: HIJSMM301DZAK5.4.39.D06.1.454.light.4.raw

SEQ ID NO: 563665 - DNA, 455 bp, Homo sapiens; identical to SEQ ID NO: 550155
  misc_feature: HIJSMM301AYWV3.5.86.H09.1.454.light.4.raw

SEQ ID NO: 563666 - DNA, 494 bp, Homo sapiens
  misc_feature: HIJSMM301EFN3C.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaacg

SEQ ID NO: 563667 - DNA, 484 bp, Homo sapiens
  misc_feature: HIJSMM301DK70C.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcccggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgcctcctcgctacgtaga

SEQ ID NO: 563668 - DNA, 491 bp, Homo sapiens
  misc_feature: HIJSMM301DN4WS.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagagtcaatcgaactgt

SEQ ID NO: 563669 - DNA, 474 bp, Homo sapiens
  misc_feature: HIJSMM301CXIT6.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagactggagatcagaacg

SEQ ID NO: 563670 - DNA, 478 bp, Homo sapiens; identical to SEQ ID NO: 535129
  misc_feature: HIJSMM301AOLXX.11.11.A11.1.454.light.4.raw

SEQ ID NO: 563671 - DNA, 502 bp, Homo sapiens; identical to SEQ ID NO: 541971
  misc_feature: HIJSMM301CR63J.4.39.D06.1.454.light.4.raw

SEQ ID NO: 563672 - DNA, 523 bp, Homo sapiens
  misc_feature: HIJSMM301EVEJ2.40.27.C05.1.454.light.4.raw
tctagcgactcacgaccggtgctcgatttagacgcgatcgaagggtttggggggggaagctcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctcccctggccatcagtgggctccggcccgaggatgaggcggattattattgtgtgtcatgggatgacagaatgaatggtccggtgttcggcggagggaccgaggctgaccgtcctaggtcagcccaaggctgccccctcggt

SEQ ID NO: 563673 - DNA, 506 bp, Homo sapiens; identical to SEQ ID NO: 537290
  misc_feature: HIJSMM301DV5V9.13.11.A11.1.454.light.4.raw

SEQ ID NO: 563674 - DNA, 496 bp, Homo sapiens
  misc_feature: HIJSMM301EW9NJ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 563675 - DNA, 520 bp, Homo sapiens
  misc_feature: HIJSMM301ASS0Z.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggtcggagggaccgaaggtagggagagtacaaaaccgaaactacgtgggctgcacccaatctgtt

SEQ ID NO: 563676 - DNA, 493 bp, Homo sapiens; identical to SEQ ID NO: 536471
  misc_feature: HIJSMM301EO4AZ.3.71.G05.1.454.light.4.raw

SEQ ID NO: 563677 - DNA, 494 bp, Homo sapiens; identical to SEQ ID NO: 535680
  misc_feature: HIJSMM301EY5P7.16.78.H01.1.454.light.4.raw

SEQ ID NO: 563678 - DNA, 464 bp, Homo sapiens; identical to SEQ ID NO: 536640
  misc_feature: HIJSMM301AZ2JV.26.78.H01.1.454.light.4.raw

SEQ ID NO: 563679 - DNA, 492 bp, Homo sapiens
  misc_feature: HIJSMM301AWTIL.48.78.H01.1.454.light.4.raw
agtatacatacacgaccggtgctcgatttagtgtgagtagtttgggtttggggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagcccg

SEQ ID NO: 563680 - DNA, 487 bp, Homo sapiens; identical to SEQ ID NO: 535583
  misc_feature: HIJSMM301C1SVN.22.73.G07.1.454.light.4.raw

SEQ ID NO: 563681 - DNA, 495 bp, Homo sapiens
  misc_feature: HIJSMM301C2YHM.18.11.A11.1.454.light.4.raw
tacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattccagaggcagcgggtctgggacagatttcactctcaccatcaccaacctgcaggctgaagatgtggcagtttattactgtcagcaatactatagtcctcctctcacgttcggcggagggtaccaaggtggagatcaaacgaactgtggctgcaccatctgtcttcatcttcccgccat

SEQ ID NO: 563682 - DNA, 496 bp, Homo sapiens
  misc_feature: HIJSMM301D7Y18.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacggactggagattaaacgaactgtggctgcaccatctgtcttcatt

SEQ ID NO: 563683 - DNA, 444 bp, Homo sapiens
  misc_feature: HIJSMM301A3UCC.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcattctgttcccgccctcctctgtcgagcgt

SEQ ID NO: 563684 - DNA, 503 bp, Homo sapiens; identical to SEQ ID NO: 541600
  misc_feature: HIJSMM301AQAWS.13.55.E11.1.454.light.4.raw

SEQ ID NO: 563685 - DNA, 446 bp, Homo sapiens
  misc_feature: HIJSMM301AZM84.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaaagtcagcccaaggctgccccctcggtcactctgttcccacccctcctccgtgtctgat

SEQ ID NO: 563686 - DNA, 490 bp, Homo sapiens
  misc_feature: HIJSMM301CMG8R.18.59.F04.1.454.light.4.raw
  modified_base (435)..(435): a, c, t, g, unknown or other
  modified_base (443)..(443): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaancaccacgnactctctatgtcttcggaactggaccaaggtcaccgtcctaggtcag

SEQ ID NO: 563687 - DNA, 504 bp, Homo sapiens; identical to SEQ ID NO: 542411
  misc_feature: HIJSMM301B65MP.9.53.E09.1.454.light.4.raw

SEQ ID NO: 563688 - DNA, 486 bp, Homo sapiens; identical to SEQ ID NO: 535043
  misc_feature: HIJSMM301CXVQC.46.35.D02.1.454.light.4.raw

SEQ ID NO: 563689 - DNA, 521 bp, Homo sapiens
  misc_feature: HIJSMM301A9BCW.7.87.H10.1.454.light.4.raw
  modified_base (484)..(484): a, c, t, g, unknown or other
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgacggaccgaacggtaggaaggtacgaaacgaacgtaagtggngtgcacactctgtcttctactcttcccgtccactctc

SEQ ID NO: 563690 - DNA, 505 bp, Homo sapiens; identical to SEQ ID NO: 535987
  misc_feature: HIJSMM301BT8WP.18.37.D04.1.454.light.4.raw

SEQ ID NO: 563691 - DNA, 509 bp, Homo sapiens
  misc_feature: HIJSMM301BVNVH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaaggaccgaaggtaggaagtacaaacgaactagtggctgcaccatctgtcttctatcttcccgccact

SEQ ID NO: 563692 - DNA, 488 bp, Homo sapiens; identical to SEQ ID NO: 537260
  misc_feature: HIJSMM301AUAXH.47.70.G04.1.454.light.4.raw

SEQ ID NO: 563693 - DNA, 499 bp, Homo sapiens; identical to SEQ ID NO: 536187
  misc_feature: HIJSMM301CESVS.11.67.G01.1.454.light.4.raw

SEQ ID NO: 563694 - DNA, 522 bp, Homo sapiens
  misc_feature: HIJSMM301D59ZM.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtccgtgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 563695 - DNA, 486 bp, Homo sapiens
  misc_feature: HIJSMM301D0N2J.52.55.E11.1.454.light.4.raw
cgcagtacgacacgaccggtgctcgatttagcactcgcacgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcgggcggagggaccaagttgaccgtcctaggtcagcccaaggctcg

SEQ ID NO: 563696 - DNA, 488 bp, Homo sapiens
  misc_feature: HIJSMM301EF4W3.48.53.E09.1.454.light.4.raw
agtatacatacacgaccggtgctcgatttagagagagtgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 563697 - DNA, 479 bp, Homo sapiens; identical to SEQ ID NO: 535586
  misc_feature: HIJSMM301DZN7G.13.34.D01.1.454.light.4.raw

SEQ ID NO: 563698 - DNA, 489 bp, Homo sapiens
  misc_feature: HIJSMM301C38O9.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctactacttttggccaggggaccaagctggagatcaaacgaa

SEQ ID NO: 563699 - DNA, 485 bp, Homo sapiens; identical to SEQ ID NO: 536263
  misc_feature: HIJSMM301DL2Y3.47.78.H01.1.454.light.4.raw

SEQ ID NO: 563700 - DNA, 489 bp, Homo sapiens; identical to SEQ ID NO: 535946
  misc_feature: HIJSMM301CXCWJ.49.33.C11.1.454.light.4.raw

SEQ ID NO: 563701 - DNA, 520 bp, Homo sapiens; identical to SEQ ID NO: 544672
  misc_feature: HIJSMM301A39BE.27.23.C01.1.454.light.4.raw

SEQ ID NO: 563702 - DNA, 467 bp, Homo sapiens; identical to SEQ ID NO: 535997
  misc_feature: HIJSMM301BMEUX.5.36.D03.1.454.light.4.raw

SEQ ID NO: 563703 - DNA, 503 bp, Homo sapiens; identical to SEQ ID NO: 537189
  misc_feature: HIJSMM301CNOEH.19.85.H08.1.454.light.4.raw

SEQ ID NO: 563704 - DNA, 482 bp, Homo sapiens; identical to SEQ ID NO: 536622
  misc_feature: HIJSMM301EW6V4.7.85.H08.1.454.light.4.raw

SEQ ID NO: 563705 - DNA, 482 bp, Homo sapiens
  misc_feature: HIJSMM301DOUHD.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtatttactttcaccatcatcaacctgcagcctgaggatattgcaacatattactgtcaacaatatgataatctaccactcacttcggtcggagggaccgacggtggagatcaaacgaaactgtggctgcaccat

SEQ ID NO: 563706 - DNA, 514 bp, Homo sapiens
  misc_feature: HIJSMM301DKMSD.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccacctcctcgctacgtagac

SEQ ID NO: 563707 - DNA, 488 bp, Homo sapiens
  misc_feature: HIJSMM301B80NY.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatcaaacgaa

SEQ ID NO: 563708 - DNA, 462 bp, Homo sapiens
  misc_feature: HIJSMM301AK31Q.17.28.C06.1.454.light.4.raw
cgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctgtctacg

SEQ ID NO: 563709 - DNA, 493 bp, Homo sapiens; identical to SEQ ID NO: 563110
  misc_feature: HIJSMM301B1FS3.16.6.A06.1.454.light.4.raw

SEQ ID NO: 563710 - DNA, 497 bp, Homo sapiens; identical to SEQ ID NO: 554406
  misc_feature: HIJSMM301AXLAB.3.33.C11.1.454.light.4.raw

SEQ ID NO: 563711 - DNA, 447 bp, Homo sapiens; identical to SEQ ID NO: 535201
  misc_feature: HIJSMM301DTQR1.18.9.A09.1.454.light.4.raw

SEQ ID NO: 563712 - DNA, 497 bp, Homo sapiens
  misc_feature: HIJSMM301EZYZG.22.27.C05.1.454.light.4.raw
  modified_base (146)..(146): a, c, t, g, unknown or other
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatntgatgacccagtctccagactccctggctgtgtctctgggcgagagggccaccatcaactgcaagtccagccagtagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatacaaacgaactgtggctgcacc

SEQ ID NO: 563713 - DNA, 513 bp, Homo sapiens
  misc_feature: HIJSMM301CG613.48.34.D01.1.454.light.4.raw
agtatacatacacgaccggtgctcgatttagatcgtctgtgttgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccctcct

SEQ ID NO: 563714 - DNA, 494 bp, Homo sapiens; identical to SEQ ID NO: 534994
  misc_feature: HIJSMM301EE0R3.27.78.H01.1.454.light.4.raw

SEQ ID NO: 563715 - DNA, 508 bp, Homo sapiens
  misc_feature: HIJSMM301CPAC9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcctacttcgtcggacgggacggaacggacggaggagtacacgaacgaacgtacgtggcgtggcaccactctcgttcttctta

SEQ ID NO: 563716 - DNA, 520 bp, Homo sapiens; identical to SEQ ID NO: 539176
  misc_feature: HIJSMM301CFWH2.27.23.C01.1.454.light.4.raw

SEQ ID NO: 563717 - DNA, 509 bp, Homo sapiens
  misc_feature: HIJSMM301CSW7Q.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaacccctac

SEQ ID NO: 563718 - DNA, 485 bp, Homo sapiens
  misc_feature: HIJSMM301EK1CK.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttatattgtcaacaatattttagtgctccgtacacttttggccaggggaccaagttggagatcaaacgaa

SEQ ID NO: 563719 - DNA, 486 bp, Homo sapiens; identical to SEQ ID NO: 552083
  misc_feature: HIJSMM301C1ZZD.47.70.G04.1.454.light.4.raw

SEQ ID NO: 563720 - DNA, 493 bp, Homo sapiens
  misc_feature: HIJSMM301BYC0K.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtctaggtcagcccaaggccaaccc

SEQ ID NO: 563721 - DNA, 504 bp, Homo sapiens; identical to SEQ ID NO: 539690
  misc_feature: HIJSMM301DTVMS.47.65.F10.1.454.light.4.raw

SEQ ID NO: 563722 - DNA, 468 bp, Homo sapiens
  misc_feature: HIJSMM301COI0Z.52.19.B08.1.454.light.4.raw
cgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttacttcaccatcagcaggctgcagcctgaagatgttgcaacatattactgtcaacagtataatcgtctcccgctcactttcggcgggggaccaaggtggagatcaagcgaactgtgctgcacc

SEQ ID NO: 563723 - DNA, 487 bp, Homo sapiens; identical to SEQ ID NO: 548740
  misc_feature: HIJSMM301AKMKH.19.71.G05.1.454.light.4.raw

SEQ ID NO: 563724 - DNA, 520 bp, Homo sapiens
  misc_feature: HIJSMM301D1PN0.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaaccccactgtcactctgttcccgccctcctcagtcgctaga

SEQ ID NO: 563725 - DNA, 511 bp, Homo sapiens; identical to SEQ ID NO: 537464
  misc_feature: HIJSMM301C5283.7.34.D01.1.454.light.4.raw

SEQ ID NO: 563726 - DNA, 509 bp, Homo sapiens
  misc_feature: HIJSMM301EMJ5J.51.35.D02.1.454.light.4.raw
cgatcgtatacacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtca

SEQ ID NO: 563727 - DNA, 486 bp, Homo sapiens; identical to SEQ ID NO: 543923
  misc_feature: HIJSMM301B15QP.3.88.H11.1.454.light.4.raw

SEQ ID NO: 563728 - DNA, 485 bp, Homo sapiens; identical to SEQ ID NO: 535688
  misc_feature: HIJSMM301AR6AX.19.5.A05.1.454.light.4.raw

SEQ ID NO: 563729 - DNA, 422 bp, Homo sapiens; identical to SEQ ID NO: 447881
  misc_feature: HIJSMM301DRTZK.9.34.D01.1.454.light.4.raw

SEQ ID NO: 563730 - DNA, 490 bp, Homo sapiens
  misc_feature: HIJSMM301CI9L6.52.25.C03.1.454.light.4.raw
cgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcacttttcggcccttgggaccaaagtggacatcaaacgaactgtggctgcaccatctgtt

SEQ ID NO: 563731 - DNA, 486 bp, Homo sapiens; identical to SEQ ID NO: 536323
  misc_feature: HIJSMM301AOEJH.10.2.A02.1.454.light.4.raw

SEQ ID NO: 563732 - DNA, 492 bp, Homo sapiens; identical to SEQ ID NO: 539630
  misc_feature: HIJSMM301DS35R.22.25.C03.1.454.light.4.raw

SEQ ID NO: 563733 - DNA, 511 bp, Homo sapiens; identical to SEQ ID NO: 546062
  misc_feature: HIJSMM301BOA0L.5.58.F03.1.454.light.4.raw

SEQ ID NO: 563734 - DNA, 344 bp, Homo sapiens; identical to SEQ ID NO: 539581
  misc_feature: HIJSMM301EKQT5.21.87.H10.1.454.light.4.raw

SEQ ID NO: 563735 - DNA, 496 bp, Homo sapiens; identical to SEQ ID NO: 535541
  misc_feature: HIJSMM301D9CFK.3.33.C11.1.454.light.4.raw

SEQ ID NO: 563736 - DNA, 481 bp, Homo sapiens
  misc_feature: HIJSMM301DPI0M.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaactttggccagggaccaagctggagatcaacgaactgtggctgcacat

SEQ ID NO: 563737 - DNA, 514 bp, Homo sapiens
  misc_feature: HIJSMM301BHXRI.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaaggcggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 563738 - DNA, 447 bp, Homo sapiens; identical to SEQ ID NO: 535020
  misc_feature: HIJSMM301DSPLR.18.9.A09.1.454.light.4.raw

SEQ ID NO: 563739 - DNA, 475 bp, Homo sapiens
  misc_feature: HIJSMM301CUDPU.19.71.G05.1.454.light.4.raw
  modified_base (445)..(445): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattactnttggagtgtccaggacgaacgaggtaggat

SEQ ID NO: 563740 - DNA, 514 bp, Homo sapiens; identical to SEQ ID NO: 538153
  misc_feature: HIJSMM301CCR3F.17.37.D04.1.454.light.4.raw

SEQ ID NO: 563741 - DNA, 509 bp, Homo sapiens; identical to SEQ ID NO: 548681
  misc_feature: HIJSMM301CVH9Q.47.83.H06.1.454.light.4.raw

SEQ ID NO: 563742 - DNA, 506 bp, Homo sapiens; identical to SEQ ID NO: 534969
  misc_feature: HIJSMM301EA52N.18.37.D04.1.454.light.4.raw

SEQ ID NO: 563743 - DNA, 489 bp, Homo sapiens
  misc_feature: HIJSMM301DBCU0.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctggaccagagtggatatcaaacgaactgtggctgcaccatctgtctt

SEQ ID NO: 563744 - DNA, 492 bp, Homo sapiens; identical to SEQ ID NO: 549170
  misc_feature: HIJSMM301A9YYL.40.81.H04.1.454.light.4.raw

SEQ ID NO: 563745 - DNA, 485 bp, Homo sapiens
  misc_feature: HIJSMM301DC44N.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcacatctgtt

SEQ ID NO: 563746 - DNA, 492 bp, Homo sapiens
  misc_feature: HIJSMM301EEWSB.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccaggacagtctccacaactcctgatctattggggttctaatcgggcctccggggtccctgacaggttcagtggcagtggatcaggcacacgattttacactgaaaatcagcagagtggaggctgaggatgttggggtttattactgcatgcaagctctacaaactctgcggactttcggccctcggaccgaaacgtaggaggaatcaaacgaactagtgg

SEQ ID NO: 563747 - DNA, 480 bp, Homo sapiens
  misc_feature: HIJSMM301DLRMH.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctttccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttacctcgtattttcggccctgggaccacagtagatatcaaacgaactgtggctgcacc

SEQ ID NO: 563748 - DNA, 485 bp, Homo sapiens
  misc_feature: HIJSMM301CW9YY.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctcctgaccattactggactccagcctgaggacgaggctgactattactgctcagcatggacgagcggcctccaggactatgtctgtactaggaccgacgtacgtaccgtacgtcgtacgaccg

SEQ ID NO: 563749 - DNA, 503 bp, Homo sapiens; identical to SEQ ID NO: 540136
  misc_feature: HIJSMM301BR468.19.10.A10.1.454.light.4.raw

SEQ ID NO: 563750 - DNA, 447 bp, Homo sapiens; identical to SEQ ID NO: 535882
  misc_feature: HIJSMM301ASRU5.18.9.A09.1.454.light.4.raw
  modified_base (429)..(429): a, c, t, g, unknown or other

SEQ ID NO: 563751 - DNA, 493 bp, Homo sapiens; identical to SEQ ID NO: 535047
  misc_feature: HIJSMM301EYPO8.16.53.E09.1.454.light.4.raw

SEQ ID NO: 563752 - DNA, 315 bp, Homo sapiens
  misc_feature: HIJSMM301BVODD.51.35.D02.1.454.light.4.raw
  modified_base (308)..(308): a, c, t, g, unknown or other
cgatcgtatacacgaccggtgctcgatttagcacacgatagttggggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgaggcgccncgagctc

SEQ ID NO: 563753 - DNA, 476 bp, Homo sapiens
  misc_feature: HIJSMM301DSCFA.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatggggctgactattactgtcaggcgtgggacagcagcactgcccgctatgtcttcggaactgggaccaaggtcaccgtcctaagtcagcccaac

SEQ ID NO: 563754 - DNA, 506 bp, Homo sapiens
  misc_feature: HIJSMM301A6ITK.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaaccccactgtcta

SEQ ID NO: 563755 - DNA, 497 bp, Homo sapiens; identical to SEQ ID NO: 535579
  misc_feature: HIJSMM301EGZ0I.26.26.C04.1.454.light.4.raw

SEQ ID NO: 563756 - DNA, 501 bp, Homo sapiens; identical to SEQ ID NO: 535746
  misc_feature: HIJSMM301BAEOC.18.11.A11.1.454.light.4.raw

SEQ ID NO: 563757 - DNA, 488 bp, Homo sapiens; identical to SEQ ID NO: 537124
  misc_feature: HIJSMM301D7UWN.11.25.C03.1.454.light.4.raw

SEQ ID NO: 563758 - DNA, 502 bp, Homo sapiens
  misc_feature: HIJSMM301EOV7R.48.86.H09.1.454.light.4.raw
  modified_base (448)..(448): a, c, t, g, unknown or other
agtatacatacacgaccggtgctcgatttagtgctatagacttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtnttcggcagagggaccaagctgaccgtcctaggtcagcccaaggctgtccccccg

SEQ ID NO: 563759 - DNA, 486 bp, Homo sapiens
  misc_feature: HIJSMM301C1569.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccatgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcat

SEQ ID NO: 563760 - DNA, 513 bp, Homo sapiens
  misc_feature: HIJSMM301ART43.13.38.D05.1.454.light.4.raw
  modified_base (495)..(495): a, c, t, g, unknown or other
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagacgaactagtggcgtgcgaccaactctntcgttctactcttcccgt

SEQ ID NO: 563761 - DNA, 498 bp, Homo sapiens
  misc_feature: HIJSMM301BUUM4.43.28.C06.1.454.light.4.raw
tgtgagtagtcacgaccggtgctcgatttagagctcacgtattgggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggcgtgaggatgttggaatttattacttgcatgcaatcttcacactggcctccgtacacttttggccaggggaccaagctggagatcaaacgaaactgt

SEQ ID NO: 563762 - DNA, 492 bp, Homo sapiens
  misc_feature: HIJSMM301BFGFA.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggattctagacgaactgtggctgcaccatctgtcttcta

SEQ ID NO: 563763 - DNA, 506 bp, Homo sapiens; identical to SEQ ID NO: 549591
  misc_feature: HIJSMM301ELCL0.17.87.H10.1.454.light.4.raw

SEQ ID NO: 563764 - DNA, 463 bp, Homo sapiens; identical to SEQ ID NO: 535062
  misc_feature: HIJSMM301CW0UL.11.73.G07.1.454.light.4.raw

SEQ ID NO: 563765 - DNA, 486 bp, Homo sapiens
  misc_feature: HIJSMM301DRH79.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaactgtgg

SEQ ID NO: 563766 - DNA, 508 bp, Homo sapiens; identical to SEQ ID NO: 536388
  misc_feature: HIJSMM301D1S3Z.11.57.F02.1.454.light.4.raw

SEQ ID NO: 563767 - DNA, 491 bp, Homo sapiens
  misc_feature: HIJSMM301DXRBD.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtcggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 563768 - DNA, 509 bp, Homo sapiens; identical to SEQ ID NO: 536047
  misc_feature: HIJSMM301BU83V.17.33.C11.1.454.light.4.raw

SEQ ID NO: 563769 - DNA, 494 bp, Homo sapiens
  misc_feature: HIJSMM301EQ93Z.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggccagtttattactgtcagcaatactatagtcctcctctcacgttcggcggagggaccaaaggtggagatcaaacgaactgtggctgcaccatctgtcttcatcttcccgccat

SEQ ID NO: 563770 - DNA, 516 bp, Homo sapiens; identical to SEQ ID NO: 537036
  misc_feature: HIJSMM301BV8R4.19.80.H03.1.454.light.4.raw

SEQ ID NO: 563771 - DNA, 494 bp, Homo sapiens; identical to SEQ ID NO: 534994
  misc_feature: HIJSMM301AVRP4.27.78.H01.1.454.light.4.raw

SEQ ID NO: 563772 - DNA, 505 bp, Homo sapiens
  misc_feature: HIJSMM301AP05O.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactatta

SEQ ID NO: 563773 - DNA, 516 bp, Homo sapiens
  misc_feature: HIJSMM301EQF4V.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgccctctcacg

SEQ ID NO: 563774 - DNA, 488 bp, Homo sapiens
  misc_feature: HIJSMM301DCDHY.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggaggaccgaaggtggaggatcaaacgaa

SEQ ID NO: 563775 - DNA, 485 bp, Homo sapiens; identical to SEQ ID NO: 544818
  misc_feature: HIJSMM301C5UMA.13.36.D03.1.454.light.4.raw

SEQ ID NO: 563776 - DNA, 507 bp, Homo sapiens
  misc_feature: HIJSMM301EVTJJ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcctgggaccaaggtggagatcaaacgaactgtggctgcaccatctgtcttcta

SEQ ID NO: 563777 - DNA, 489 bp, Homo sapiens; identical to SEQ ID NO: 542780
  misc_feature: HIJSMM301CCZBE.16.53.E09.1.454.light.4.raw

SEQ ID NO: 563778 - DNA, 503 bp, Homo sapiens
  misc_feature: HIJSMM301CZ03V.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggaggaccaagctgaccgtcttagtcagcccaagg

SEQ ID NO: 563779 - DNA, 503 bp, Homo sapiens
  misc_feature: HIJSMM301CNXNF.12.67.G01.1.454.light.4.raw
atacgacgtacacgaccggtgctcgatttagagtatacatattgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaacccc

SEQ ID NO: 563780 - DNA, 493 bp, Homo sapiens
  misc_feature: HIJSMM301CQ9W3.52.29.C07.1.454.light.4.raw
cgcagtacgacacgaccggtgctcgatttagagtgctacgaagggaaaggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacgg

SEQ ID NO: 563781 - DNA, 489 bp, Homo sapiens; identical to SEQ ID NO: 535139
  misc_feature: HIJSMM301CBPAH.14.55.E11.1.454.light.4.raw

SEQ ID NO: 563782 - DNA, 491 bp, Homo sapiens
  misc_feature: HIJSMM301C0PNU.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaatcaagcgaactgtggctgcaccatctgtcttcatt

SEQ ID NO: 563783 - DNA, 465 bp, Homo sapiens; identical to SEQ ID NO: 541152
  misc_feature: HIJSMM301BJI9A.43.71.G05.1.454.light.4.raw

SEQ ID NO: 563784 - DNA, 486 bp, Homo sapiens; identical to SEQ ID NO: 535043
  misc_feature: HIJSMM301AJO4Z.46.35.D02.1.454.light.4.raw

SEQ ID NO: 563785 - DNA, 489 bp, Homo sapiens; identical to SEQ ID NO: 544329
  misc_feature: HIJSMM301AW18I.11.28.C06.1.454.light.4.raw

SEQ ID NO: 563786 - DNA, 521 bp, Homo sapiens; identical to SEQ ID NO: 539470
  misc_feature: HIJSMM301CF7W9.27.23.C01.1.454.light.4.raw

SEQ ID NO: 563787 - DNA, 493 bp, Homo sapiens; identical to SEQ ID NO: 536769
  misc_feature: HIJSMM301B3FRU.19.83.H06.1.454.light.4.raw

SEQ ID NO: 563788 - DNA, 495 bp, Homo sapiens
  misc_feature: HIJSMM301DV4G0.3.14.B03.1.454.light.4.raw
agacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctgtgggggaaacaaaattggagataaaagtgtgcactggtaccagcagaagccaggccaggcccctgtgctggtcatccattctgatagcgaccgcccctcagggatccctgagcgattctctggctccaactctgcgaacacggccaccctgaccatcagcagggtcgaagccggggatgaggccgactattcttgtcaggtgtgggatagtagtactgtgatattcggcggagggaccaagctgaccgtcctaggtcagcccaaggctgccccctcggtcactctgttcccaccctcctccgagtgcgtct

SEQ ID NO: 563789 - DNA, 482 bp, Homo sapiens
  misc_feature: HIJSMM301ARCKP.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcacc

SEQ ID NO: 563790 - DNA, 492 bp, Homo sapiens; identical to SEQ ID NO: 555682
  misc_feature: HIJSMM301EVSM2.16.78.H01.1.454.light.4.raw

SEQ ID NO: 563791 - DNA, 517 bp, Homo sapiens; identical to SEQ ID NO: 543501
  misc_feature: HIJSMM301CCYM9.47.53.E09.1.454.light.4.raw

SEQ ID NO: 563792 - DNA, 490 bp, Homo sapiens
  misc_feature: HIJSMM301EHZ3I.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaacgaactgtggctgcaccatctgtcttcat

SEQ ID NO: 563793 - DNA, 485 bp, Homo sapiens
  misc_feature: HIJSMM301BR0AF.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggccaagctgaccgtcctaggtcagcccaaggctcg

SEQ ID NO: 563794 - DNA, 487 bp, Homo sapiens; identical to SEQ ID NO: 536206
  misc_feature: HIJSMM301DOD6E.47.38.D05.1.454.light.4.raw

SEQ ID NO: 563795 - DNA, 490 bp, Homo sapiens
  misc_feature: HIJSMM301A2YY4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccaaggcggagatcagacgaactgtggctgcaccatctgtcttcta

SEQ ID NO: 563796 - DNA, 444 bp, Homo sapiens
  misc_feature: HIJSMM301CTDWU.18.9.A09.1.454.light.4.raw
tacgagtatgcacgaccggtgctcgatttagcgagacgcgcagggtcctggacccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 563797 - DNA, 496 bp, Homo sapiens; identical to SEQ ID NO: 536802
  misc_feature: HIJSMM301C5NYD.5.24.C02.1.454.light.4.raw

SEQ ID NO: 563798 - DNA, 489 bp, Homo sapiens
  misc_feature: HIJSMM301CHHQM.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtggaccaagctgaccgtcctaggtcagccc

SEQ ID NO: 563799 - DNA, 510 bp, Homo sapiens
  misc_feature: HIJSMM301CWJQU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctcgggtcagcccaaggcctcgccccctcggtctacc

SEQ ID NO: 563800 - DNA, 484 bp, Homo sapiens
  misc_feature: HIJSMM301BD2MB.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggtcgctcaccttcggccaagggacacgactggagattaaacgaactgtggctgcaccat

SEQ ID NO: 563801 - DNA, 486 bp, Homo sapiens; identical to SEQ ID NO: 551009
  misc_feature: HIJSMM301BBT5X.15.1.A01.1.454.light.4.raw

SEQ ID NO: 563802 - DNA, 495 bp, Homo sapiens
  misc_feature: HIJSMM301ATUQW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggaggatacagacgaactagtggctgcaccatctgtcttcta

SEQ ID NO: 563803 - DNA, 500 bp, Homo sapiens
  misc_feature: HIJSMM301A77EQ.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttcccaccctcctccacgagagta

SEQ ID NO: 563804 - DNA, 498 bp, Homo sapiens
  misc_feature: HIJSMM301B2U13.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgctagtttattattgtcagcagtataataactggcctccgtggacgttcggccaagggaccaaggtggaaatcaaacgaactgtggctgcaccatctgtcttc

SEQ ID NO: 563805 - DNA, 490 bp, Homo sapiens; identical to SEQ ID NO: 543909
  misc_feature: HIJSMM301DI3BT.14.55.E11.1.454.light.4.raw

SEQ ID NO: 563806 - DNA, 416 bp, Homo sapiens; identical to SEQ ID NO: 545902
  misc_feature: HIJSMM301D8AX1.18.78.H01.1.454.light.4.raw

SEQ ID NO: 563807 - DNA, 482 bp, Homo sapiens
  misc_feature: HIJSMM301A6H4T.12.1.A01.1.454.light.4.raw
  modified_base (452)..(452): a, c, t, g, unknown or other
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggacgaacggtaggagatnaaacgaactacgtggctgcaccactctgtt

SEQ ID NO: 563808 - DNA, 495 bp, Homo sapiens
  misc_feature: HIJSMM301DBD7O.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaa

SEQ ID NO: 563809 - DNA, 474 bp, Homo sapiens
  misc_feature: HIJSMM301AW7XH.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcaatggatctgggacagatttcactctcgccatcagtagtctgcaacctgatgattttgcaacttactactgtcaacagagttccactaccccaatcacttcggcctgggactgaagtgcatatgaagagaactgtggctgca

SEQ ID NO: 563810 - DNA, 489 bp, Homo sapiens; identical to SEQ ID NO: 535386
  misc_feature: HIJSMM301ELKYK.12.51.E07.1.454.light.4.raw

SEQ ID NO: 563811 - DNA, 500 bp, Homo sapiens; identical to SEQ ID NO: 546613
  misc_feature: HIJSMM301EYHD3.11.21.B10.1.454.light.4.raw

SEQ ID NO: 563812 - DNA, 489 bp, Homo sapiens; identical to SEQ ID NO: 538498
  misc_feature: HIJSMM301BSEC0.19.71.G05.1.454.light.4.raw

SEQ ID NO: 563813 - DNA, 485 bp, Homo sapiens; identical to SEQ ID NO: 540394
  misc_feature: HIJSMM301D5ADA.46.26.C04.1.454.light.4.raw

SEQ ID NO: 563814 - DNA, 480 bp, Homo sapiens; identical to SEQ ID NO: 535291
  misc_feature: HIJSMM301EQH9M.22.59.F04.1.454.light.4.raw

SEQ ID NO: 563815 - DNA, 472 bp, Homo sapiens
  misc_feature: HIJSMM301BUE84.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattaggtatcaacagagcccaggaaaagccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccagggacgaagctggagatcgaacgaactgtggctgcaccatctgtcttcatcttcccgccatctgagacacgcgag

SEQ ID NO: 563816 - DNA, 492 bp, Homo sapiens; identical to SEQ ID NO: 552746
  misc_feature: HIJSMM301C7FE2.21.9.A09.1.454.light.4.raw

SEQ ID NO: 563817 - DNA, 506 bp, Homo sapiens; identical to SEQ ID NO: 551204
  misc_feature: HIJSMM301AJ4ZO.15.59.F04.1.454.light.4.raw

SEQ ID NO: 563818 - DNA, 444 bp, Homo sapiens
  misc_feature: HIJSMM301B5JKP.5.9.A09.1.454.light.4.raw
atcagacacgcacgaccggtgctcgatttagcgagacgcgcagggtcctgggcccagtctgtggtgacgcaaccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 563819 - DNA, 484 bp, Homo sapiens
  misc_feature: HIJSMM301BZW5B.41.68.G02.1.454.light.4.raw
tctatactatcacgaccggtgctcgatttagtcgatagtgaagggaaaggggagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggaggatcaaacgaactgtggctgcaccatctgtt

SEQ ID NO: 563820 - DNA, 497 bp, Homo sapiens
  misc_feature: HIJSMM301DKZ70.21.15.B04.1.454.light.4.raw
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggcagttatttttgtatgcaacattatgccgctccgctcactttcggcggagggaccaaggtggagatcaaacgaactgtggctgcaccat

SEQ ID NO: 563821 - DNA, 504 bp, Homo sapiens
  misc_feature: HIJSMM301BIXYU.9.53.E09.1.454.light.4.raw
  modified_base (457)..(457): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggnggagggaccaaggtgaccgtctaggtcagcccaaggctcgccccccg

SEQ ID NO: 563822 - DNA, 504 bp, Homo sapiens
  misc_feature: HIJSMM301C4H4P.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaaacatattagctggttaatttggtatcagcagaaagcaggaaaagccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtaggagatcaaaggaactgtggctgcaccatctgtcttcactcttcccgccta

SEQ ID NO: 563823 - DNA, 498 bp, Homo sapiens
  misc_feature: HIJSMM301CTVXE.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcggccgacgggaccgacggtcggagtggtctaagacgaacgtagtggcgtcgcaccta

SEQ ID NO: 563824 - DNA, 501 bp, Homo sapiens
  misc_feature: HIJSMM301C7B79.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctgttcccgccctcctcgctacgtaga

SEQ ID NO: 563825 - DNA, 494 bp, Homo sapiens; identical to SEQ ID NO: 549057
  misc_feature: HIJSMM301AXLNI.10.33.C11.1.454.light.4.raw

SEQ ID NO: 563826 - DNA, 441 bp, Homo sapiens; identical to SEQ ID NO: 534971
  misc_feature: HIJSMM301BF5V4.11.3.A03.1.454.light.4.raw

SEQ ID NO: 563827 - DNA, 501 bp, Homo sapiens; identical to SEQ ID NO: 542272
  misc_feature: HIJSMM301EEUFV.15.56.F01.1.454.light.4.raw
  modified_base (483)..(483): a, c, t, g, unknown or other

SEQ ID NO: 563828 - DNA, 504 bp, Homo sapiens; identical to SEQ ID NO: 539091
  misc_feature: HIJSMM301BWGO9.8.28.C06.1.454.light.4.raw

SEQ ID NO: 563829 - DNA, 487 bp, Homo sapiens; identical to SEQ ID NO: 555321
  misc_feature: HIJSMM301BKHAQ.19.71.G05.1.454.light.4.raw

SEQ ID NO: 563830 - DNA, 454 bp, Homo sapiens; identical to SEQ ID NO: 536449
  misc_feature: HIJSMM301CWI9Z.18.78.H01.1.454.light.4.raw

SEQ ID NO: 563831 - DNA, 484 bp, Homo sapiens; identical to SEQ ID NO: 535400
  misc_feature: HIJSMM301B4V1J.46.26.C04.1.454.light.4.raw

SEQ ID NO: 563832 - DNA, 508 bp, Homo sapiens
  misc_feature: HIJSMM301DXMNY.47.83.H06.1.454.light.4.raw
  modified_base (451)..(451): a, c, t, g, unknown or other
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaaagctgccctcaccatcgcgggggcccaggcagatgatgagtgtgattattaactgtntgctctatatggcagtggcgtttgggtgttcggcggagggaccgaagcgtgacgtcg

SEQ ID NO: 563833 - DNA, 501 bp, Homo sapiens; identical to SEQ ID NO: 535873
  misc_feature: HIJSMM301AVACJ.17.27.C05.1.454.light.4.raw

SEQ ID NO: 563834 - DNA, 485 bp, Homo sapiens; identical to SEQ ID NO: 544293
  misc_feature: HIJSMM301CDH4Q.26.70.G04.1.454.light.4.raw

SEQ ID NO: 563835 - DNA, 495 bp, Homo sapiens; identical to SEQ ID NO: 543724
  misc_feature: HIJSMM301C7XKX.15.59.F04.1.454.light.4.raw

SEQ ID NO: 563836 - DNA, 523 bp, Homo sapiens
  misc_feature: HIJSMM301EMQSP.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagacccctggacgcctcagttggaagcagccgatccagcctgcggagcctgtggggcagggtcaggcccaaggccaaccccactcgtcactctcg

SEQ ID NO: 563837 - DNA, 483 bp, Homo sapiens
  misc_feature: HIJSMM301CPKAQ.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtgctgcacc

SEQ ID NO: 563838 - DNA, 495 bp, Homo sapiens
  misc_feature: HIJSMM301EF4KG.51.29.C07.1.454.light.4.raw
cgatcgtatacacgaccggtgctcgatttagagtgctacgaagggaaaggggaggaactgctcagtcaggacccagacggaaccatggaagccccacgcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 563839 - DNA, 478 bp, Homo sapiens
  misc_feature: HIJSMM301BR793.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 563840 - DNA, 494 bp, Homo sapiens; identical to SEQ ID NO: 534992
  misc_feature: HIJSMM301B0TK0.9.1.A01.1.454.light.4.raw

SEQ ID NO: 563841 - DNA, 494 bp, Homo sapiens; identical to SEQ ID NO: 534992
  misc_feature: HIJSMM301EWRE8.9.1.A01.1.454.light.4.raw

SEQ ID NO: 563842 - DNA, 443 bp, Homo sapiens; identical to SEQ ID NO: 547180
  misc_feature: HIJSMM301BSTOK.5.9.A09.1.454.light.4.raw

SEQ ID NO: 563843 - DNA, 513 bp, Homo sapiens
  misc_feature: HIJSMM301CG0R3.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccg

SEQ ID NO: 563844 - DNA, 503 bp, Homo sapiens
  misc_feature: HIJSMM301DZYOR.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtgaaatcaaacgaactgtggctgcaccat

SEQ ID NO: 563845 - DNA, 511 bp, Homo sapiens
  misc_feature: HIJSMM301EOYKU.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccaccctcct

SEQ ID NO: 563846 - DNA, 526 bp, Homo sapiens
  misc_feature: HIJSMM301DZSJ6.9.25.C03.1.454.light.4.raw
tgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctcggtcactctgttcccaccctcctcagacg

SEQ ID NO: 563847 - DNA, 497 bp, Homo sapiens; identical to SEQ ID NO: 540789
  misc_feature: HIJSMM301D1DSD.9.67.G01.1.454.light.4.raw

SEQ ID NO: 563848 - DNA, 497 bp, Homo sapiens
  misc_feature: HIJSMM301CO9E5.49.34.D01.1.454.light.4.raw
agtcgagagacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagccaaggctgcccctcggtc

SEQ ID NO: 563849 - DNA, 495 bp, Homo sapiens; identical to SEQ ID NO: 542416
  misc_feature: HIJSMM301ENNZO.27.78.H01.1.454.light.4.raw

SEQ ID NO: 563850 - DNA, 470 bp, Homo sapiens
  misc_feature: HIJSMM301AP9EL.14.55.E11.1.454.light.4.raw
  modified_base (453)..(453): a, c, t, g, unknown or other
  modified_base (456)..(456): a, c, t, g, unknown or other
  modified_base (458)..(458): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctctacgttcggacggacggacgaggngananacgacgacgagt

SEQ ID NO: 563851 - DNA, 486 bp, Homo sapiens; identical to SEQ ID NO: 553608
  misc_feature: HIJSMM301CFDWT.11.12.B01.1.454.light.4.raw

SEQ ID NO: 563852 - DNA, 517 bp, Homo sapiens
  misc_feature: HIJSMM301C3VW8.41.30.C08.1.454.light.4.raw
tctatactatcacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcacgtcctaggtcagcccaaggccaaccccactgtcactctgttccccg

SEQ ID NO: 563853 - DNA, 490 bp, Homo sapiens; identical to SEQ ID NO: 535234
  misc_feature: HIJSMM301A34H8.17.21.B10.1.454.light.4.raw

SEQ ID NO: 563854 - DNA, 462 bp, Homo sapiens; identical to SEQ ID NO: 542244
  misc_feature: HIJSMM301CZFIP.49.73.G07.1.454.light.4.raw

SEQ ID NO: 563855 - DNA, 500 bp, Homo sapiens; identical to SEQ ID NO: 546613
  misc_feature: HIJSMM301ARPEL.11.21.B10.1.454.light.4.raw

SEQ ID NO: 563856 - DNA, 489 bp, Homo sapiens; identical to SEQ ID NO: 554724
  misc_feature: HIJSMM301BKHAZ.17.21.B10.1.454.light.4.raw

SEQ ID NO: 563857 - DNA, 486 bp, Homo sapiens; identical to SEQ ID NO: 535917
  misc_feature: HIJSMM301CTA2Y.3.10.A10.1.454.light.4.raw

SEQ ID NO: 563858 - DNA, 500 bp, Homo sapiens
  misc_feature: HIJSMM301ALX76.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatacaaacgaactgtggctgcacca

SEQ ID NO: 563859 - DNA, 507 bp, Homo sapiens; identical to SEQ ID NO: 539817
  misc_feature: HIJSMM301DRRVK.5.24.C02.1.454.light.4.raw

SEQ ID NO: 563860 - DNA, 488 bp, Homo sapiens; identical to SEQ ID NO: 537260
  misc_feature: HIJSMM301CMO1Z.47.70.G04.1.454.light.4.raw

SEQ ID NO: 563861 - DNA, 515 bp, Homo sapiens
  misc_feature: HIJSMM301DXAM7.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccactgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccgcctcctccc

SEQ ID NO: 563862 - DNA, 480 bp, Homo sapiens
  misc_feature: HIJSMM301D529I.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggttgtgcttttcggcggagggaccaagctgaccgtcctacgtcagcccaaggctgccccctc

SEQ ID NO: 563863 - DNA, 497 bp, Homo sapiens; identical to SEQ ID NO: 536371
  misc_feature: HIJSMM301AM368.16.78.H01.1.454.light.4.raw

SEQ ID NO: 563864 - DNA, 489 bp, Homo sapiens; identical to SEQ ID NO: 535386
  misc_feature: HIJSMM301B4CPQ.12.51.E07.1.454.light.4.raw

SEQ ID NO: 563865 - DNA, 480 bp, Homo sapiens
  misc_feature: HIJSMM301DUH8Q.51.34.D01.1.454.light.4.raw
cgatcgtatacacgaccggtgctcgatttagatcgtctgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccgaaggtggagatcaagcgaactgtggctgcaccatctgt

SEQ ID NO: 563866 - DNA, 489 bp, Homo sapiens
  misc_feature: HIJSMM301CWET0.46.35.D02.1.454.light.4.raw
actagcagtacacgaccggtgctcgatttagcacacgatagttgggtttgggggagctgctcagttaggacccagagggaaccatggaaaccccagcgcagtttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagacttttggccaggggaccaagctggagatcaaacgaactgtggctgcaccatctgt

SEQ ID NO: 563867 - DNA, 488 bp, Homo sapiens; identical to SEQ ID NO: 535861
  misc_feature: HIJSMM301EEEN6.14.55.E11.1.454.light.4.raw

SEQ ID NO: 563868 - DNA, 480 bp, Homo sapiens
  misc_feature: HIJSMM301BPD9D.48.33.C11.1.454.light.4.raw
agtatacatacacgaccggtgctcgatttagagtgagctcgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 563869 - DNA, 483 bp, Homo sapiens
  misc_feature: HIJSMM301CVYRX.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcgcggagggaccaaggtggagatcaaacgaa

SEQ ID NO: 563870 - DNA, 486 bp, Homo sapiens; identical to SEQ ID NO: 535523
  misc_feature: HIJSMM301AUPIX.22.73.G07.1.454.light.4.raw

SEQ ID NO: 563871 - DNA, 500 bp, Homo sapiens
  misc_feature: HIJSMM301D75ZQ.19.78.H01.1.454.light.4.raw
  modified_base (496)..(496): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaagccaacccacngtca

SEQ ID NO: 563872 - DNA, 497 bp, Homo sapiens; identical to SEQ ID NO: 539718
  misc_feature: HIJSMM301D136H.40.54.E10.1.454.light.4.raw

SEQ ID NO: 563873 - DNA, 497 bp, Homo sapiens
  misc_feature: HIJSMM301B6ZUS.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccacgggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtggaaatacaaacgaactagtggctgcaccatctgtcttcatt

SEQ ID NO: 563874 - DNA, 488 bp, Homo sapiens
  misc_feature: HIJSMM301BKNNS.12.31.C09.1.454.light.4.raw
  modified_base (366)..(366): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttacnctcaccatcagtagtctacagcctgaagatattgctacttattactgtcagcagagttaccgcgctcccatcactttcggccaagggacacgaccgcagattggacgaactgtggctgcacc

SEQ ID NO: 563875 - DNA, 482 bp, Homo sapiens; identical to SEQ ID NO: 537205
  misc_feature: HIJSMM301AZXXZ.5.39.D06.1.454.light.4.raw

SEQ ID NO: 563876 - DNA, 497 bp, Homo sapiens; identical to SEQ ID NO: 541552
  misc_feature: HIJSMM301ANL6R.48.82.H05.1.454.light.4.raw

SEQ ID NO: 563877 - DNA, 494 bp, Homo sapiens; identical to SEQ ID NO: 534994
  misc_feature: HIJSMM301CPU2Y.27.78.H01.1.454.light.4.raw

SEQ ID NO: 563878 - DNA, 489 bp, Homo sapiens; identical to SEQ ID NO: 562293
  misc_feature: HIJSMM301EZ1P4.3.10.A10.1.454.light.4.raw

SEQ ID NO: 563879 - DNA, 474 bp, Homo sapiens
  misc_feature: HIJSMM301CJFQE.48.53.E09.1.454.light.4.raw
agtatacatacacgaccggtgctcgatttagagagagtgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcag

SEQ ID NO: 563880 - DNA, 493 bp, Homo sapiens
  misc_feature: HIJSMM301EBF4L.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaacaatgtggtcagtggcctcgaacgttcggccagggaccacagtggatatcaggcgaactgtggctgcaccatctgtctt

SEQ ID NO: 563881 - DNA, 492 bp, Homo sapiens; identical to SEQ ID NO: 552746
  misc_feature: HIJSMM301CO6BV.21.9.A09.1.454.light.4.raw

SEQ ID NO: 563882 - DNA, 491 bp, Homo sapiens
  misc_feature: HIJSMM301B2ZS0.19.10.A10.1.454.light.4.raw
tactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtgg

SEQ ID NO: 563883 - DNA, 499 bp, Homo sapiens; identical to SEQ ID NO: 542463
  misc_feature: HIJSMM301DQGJ9.26.26.C04.1.454.light.4.raw

SEQ ID NO: 563884 - DNA, 488 bp, Homo sapiens
  misc_feature: HIJSMM301AQQZB.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacaggtaacagtttcccgctcaccttcggcggagggaccaaggtggagatgaaaagaactgtggctgcaccat

SEQ ID NO: 563885 - DNA, 482 bp, Homo sapiens
  misc_feature: HIJSMM301AGY5D.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctcgggaccaatgtggatatcaaacgaactgtggctgcaccatctgtt

SEQ ID NO: 563886 - DNA, 506 bp, Homo sapiens; identical to SEQ ID NO: 539721
  misc_feature: HIJSMM301A91AU.3.79.H02.1.454.light.4.raw

SEQ ID NO: 563887 - DNA, 494 bp, Homo sapiens
  misc_feature: HIJSMM301CBR6A.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgacggaccgaaggtggaaggtcaaacgaactgtggcgtgcaccatctgtctt

SEQ ID NO: 563888 - DNA, 497 bp, Homo sapiens
  misc_feature: HIJSMM301DXDPV.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccgaaggaccgaacggtaggaaagtacaaacgaaactagtggcgtgcaccacta

SEQ ID NO: 563889 - DNA, 513 bp, Homo sapiens
  misc_feature: HIJSMM301D7UPG.5.58.F03.1.454.light.4.raw
atcagacacgcacgaccggtgctcgatttagtctgatcgagaagggaaagggggtcacaagaggcagcgctctcgggacgtctccaccatggcctggactctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagccccctaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtccacgtcctaggtcagcccaaggccaaccccactcgtcactcttcg

SEQ ID NO: 563890 - DNA, 494 bp, Homo sapiens
  misc_feature: HIJSMM301D5GA1.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctggaccgaaagtggagatcaaacgaactgtggctgcaccatctgtctt

SEQ ID NO: 563891 - DNA, 508 bp, Homo sapiens; identical to SEQ ID NO: 547873
  misc_feature: HIJSMM301BK904.47.83.H06.1.454.light.4.raw

SEQ ID NO: 563892 - DNA, 475 bp, Homo sapiens; identical to SEQ ID NO: 537714
  misc_feature: HIJSMM301A8DCJ.7.81.H04.1.454.light.4.raw

SEQ ID NO: 563893 - DNA, 516 bp, Homo sapiens; identical to SEQ ID NO: 544353
  misc_feature: HIJSMM301CZH1O.47.53.E09.1.454.light.4.raw

SEQ ID NO: 563894 - DNA, 447 bp, Homo sapiens; identical to SEQ ID NO: 535020
  misc_feature: HIJSMM301AWY0Z.18.9.A09.1.454.light.4.raw

SEQ ID NO: 563895 - DNA, 496 bp, Homo sapiens
  misc_feature: HIJSMM301CZL6K.48.1.A01.1.454.light.4.raw
agtatacatacacgaccggtgctcgatttagacgtctcatcaggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttcccctcccactttcggcggagggaccagggtggacgtcaaacgaactgtggctgcaccatctgtcttcatcttcccg

SEQ ID NO: 563896 - DNA, 500 bp, Homo sapiens
  misc_feature: HIJSMM301DTR3W.48.38.D05.1.454.light.4.raw
agtatacatacacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 563897 - DNA, 505 bp, Homo sapiens; identical to SEQ ID NO: 546460
  misc_feature: HIJSMM301BPHAB.15.5.A05.1.454.light.4.raw

SEQ ID NO: 563898 - DNA, 501 bp, Homo sapiens; identical to SEQ ID NO: 548357
  misc_feature: HIJSMM301EJEXT.19.67.G01.1.454.light.4.raw

SEQ ID NO: 563899 - DNA, 512 bp, Homo sapiens; identical to SEQ ID NO: 552719
  misc_feature: HIJSMM301DHBIA.22.36.D03.1.454.light.4.raw

SEQ ID NO: 563900 - DNA, 506 bp, Homo sapiens
  misc_feature: HIJSMM301BJ7EO.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcaaacccccactgtca

SEQ ID NO: 563901 - DNA, 505 bp, Homo sapiens
  misc_feature: HIJSMM301EZ77I.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaaactgtggctgcaccatctgtcttctatcc

SEQ ID NO: 563902 - DNA, 534 bp, Homo sapiens
  misc_feature: HIJSMM301B7SFV.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggcccaaaggtacgacgaacgtacggtaggagtaaaaggttaaacggtaacgttggtcggtcgtcgaccaacctacttcgttcgtttccttctactttcccccg

SEQ ID NO: 563903 - DNA, 493 bp, Homo sapiens; identical to SEQ ID NO: 540127
  misc_feature: HIJSMM301A4BH4.10.17.B06.1.454.light.4.raw

SEQ ID NO: 563904 - DNA, 454 bp, Homo sapiens
  misc_feature: HIJSMM301EESZZ.19.86.H09.1.454.light.4.raw
tactctcgtgcacgaccggtgctcgatttagtgctatagacttgggtttgggggccgttcctgggcccagtctgtgctgactcaggaaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 563905 - DNA, 505 bp, Homo sapiens
  misc_feature: HIJSMM301DPIVG.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtgaggctgaggatgttggggtttattactgcatgcaaactacacacggccgctcactttcggcggagggaccaaggtggagatcaaacgaactgtggctgcaccatctgtt

SEQ ID NO: 563906 - DNA, 496 bp, Homo sapiens
  misc_feature: HIJSMM301DP41H.40.23.C01.1.454.light.4.raw
tctagcgactcacgaccggtgctcgatttagtacacgtgattaggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatt

SEQ ID NO: 563907 - DNA, 488 bp, Homo sapiens; identical to SEQ ID NO: 535861
  misc_feature: HIJSMM301C6WRC.14.55.E11.1.454.light.4.raw

SEQ ID NO: 563908 - DNA, 503 bp, Homo sapiens; identical to SEQ ID NO: 543938
  misc_feature: HIJSMM301BUXO6.4.71.G05.1.454.light.4.raw

SEQ ID NO: 563909 - DNA, 490 bp, Homo sapiens; identical to SEQ ID NO: 538999
  misc_feature: HIJSMM301AR4YR.16.86.H09.1.454.light.4.raw

SEQ ID NO: 563910 - DNA, 476 bp, Homo sapiens
  misc_feature: HIJSMM301BMO22.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcaactttcggccctggactgaagtgcatatgaagagaactgtggctgca

SEQ ID NO: 563911 - DNA, 488 bp, Homo sapiens; identical to SEQ ID NO: 539884
  misc_feature: HIJSMM301EIZLV.7.85.H08.1.454.light.4.raw

SEQ ID NO: 563912 - DNA, 502 bp, Homo sapiens
  misc_feature: HIJSMM301B62TL.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggaggaccaaactgaccgtcctaggtcagcccaaggctgccccctc

SEQ ID NO: 563913 - DNA, 447 bp, Homo sapiens; identical to SEQ ID NO: 535882
  misc_feature: HIJSMM301EFV4S.18.9.A09.1.454.light.4.raw
  modified_base (429)..(429): a, c, t, g, unknown or other

SEQ ID NO: 563914 - DNA, 484 bp, Homo sapiens; identical to SEQ ID NO: 535240
  misc_feature: HIJSMM301B9CWV.47.60.F05.1.454.light.4.raw

SEQ ID NO: 563915 - DNA, 486 bp, Homo sapiens; identical to SEQ ID NO: 535043
  misc_feature: HIJSMM301BTGCV.46.35.D02.1.454.light.4.raw

SEQ ID NO: 563916 - DNA, 487 bp, Homo sapiens; identical to SEQ ID NO: 546877
  misc_feature: HIJSMM301AJVPG.41.44.D11.1.454.light.4.raw

SEQ ID NO: 563917 - DNA, 508 bp, Homo sapiens; identical to SEQ ID NO: 535835
  misc_feature: HIJSMM301ED8P4.8.34.D01.1.454.light.4.raw

SEQ ID NO: 563918 - DNA, 479 bp, Homo sapiens; identical to SEQ ID NO: 559274
  misc_feature: HIJSMM301D844B.11.11.A11.1.454.light.4.raw

SEQ ID NO: 563919 - DNA, 503 bp, Homo sapiens; identical to SEQ ID NO: 559148
  misc_feature: HIJSMM301DCOSQ.7.31.C09.1.454.light.4.raw

SEQ ID NO: 563920 - DNA, 483 bp, Homo sapiens
  misc_feature: HIJSMM301CM72Y.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctctcgctactaga

SEQ ID NO: 563921 - DNA, 532 bp, Homo sapiens
  misc_feature: HIJSMM301AUAPT.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttatattgtcagcagcgtagcaggtggccgtttctacttcggtcccggggacccggaaacgtaggaaagtacaaaccgaaacgtagtaggtcgtggcaccactctgtctttctactcttcccgtcccact

SEQ ID NO: 563922 - DNA, 506 bp, Homo sapiens; identical to SEQ ID NO: 550551
  misc_feature: HIJSMM301DP325.16.1.A01.1.454.light.4.raw

SEQ ID NO: 563923 - DNA, 476 bp, Homo sapiens
  misc_feature: HIJSMM301EBTBQ.7.81.H04.1.454.light.4.raw
  modified_base (410)..(410): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacanagttccactaccccaatcacttcggccctcgggactgaagtgcatatgaagagaactgtggctgca

SEQ ID NO: 563924 - DNA, 495 bp, Homo sapiens; identical to SEQ ID NO: 538269
  misc_feature: HIJSMM301BLA84.9.1.A01.1.454.light.4.raw

SEQ ID NO: 563925 - DNA, 518 bp, Homo sapiens
  misc_feature: HIJSMM301AVMZ2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctcccgggctccagcctgaggacgagggctgattattattgtagttcatatacaaccagtgacacttgggtgttcggcggagggaccaggctgaccgtcctaggtcagcccaaggctgccccctcggtcactctgttccc

SEQ ID NO: 563926 - DNA, 503 bp, Homo sapiens
  misc_feature: HIJSMM301BR0XU.9.53.E09.1.454.light.4.raw
tgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgaccaatctctgggctccaggctgaggacgaggctgattattactgctgctcatatgcagatggtgacactcccgtggtattcggcggaggaccaaggtgaccgtcctaggtcagcccaaggctgtcccccg

SEQ ID NO: 563927 - DNA, 460 bp, Homo sapiens; identical to SEQ ID NO: 538409
  misc_feature: HIJSMM301C5NN1.11.86.H09.1.454.light.4.raw
  modified_base (442)..(442): a, c, t, g, unknown or other

SEQ ID NO: 563928 - DNA, 517 bp, Homo sapiens; identical to SEQ ID NO: 555794
  misc_feature: HIJSMM301EPCGA.14.70.G04.1.454.light.4.raw

SEQ ID NO: 563929 - DNA, 526 bp, Homo sapiens
  misc_feature: HIJSMM301B0KDP.9.86.H09.1.454.light.4.raw
tgatacgtctcacgaccggtgctcgatttagtgctatagacttgggtttggggggggtcgacaagaggcagcgctctcgggacggtctccaccatggccgtgggcgtctgctgctcctcaccctcctcactcaggacgcagggtccgtgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtggttcggcggagggaccaagctgaccgtcctaggtcagcccaaggctgccccctcggtcactttgttcccgccctcctca

SEQ ID NO: 563930 - DNA, 485 bp, Homo sapiens; identical to SEQ ID NO: 535501
  misc_feature: HIJSMM301DAGPN.3.10.A10.1.454.light.4.raw

SEQ ID NO: 563931 - DNA, 487 bp, Homo sapiens; identical to SEQ ID NO: 537079
  misc_feature: HIJSMM301BA9Q3.14.55.E11.1.454.light.4.raw

SEQ ID NO: 563932 - DNA, 477 bp, Homo sapiens; identical to SEQ ID NO: 539277
  misc_feature: HIJSMM301ECI9G.4.10.A10.1.454.light.4.raw

SEQ ID NO: 563933 - DNA, 445 bp, Homo sapiens; identical to SEQ ID NO: 537719
  misc_feature: HIJSMM301CB91M.47.85.H08.1.454.light.4.raw

SEQ ID NO: 563934 - DNA, 491 bp, Homo sapiens; identical to SEQ ID NO: 553956
  misc_feature: HIJSMM301AHVP5.4.22.B11.1.454.light.4.raw

SEQ ID NO: 563935 - DNA, 500 bp, Homo sapiens
  misc_feature: HIJSMM301B2HN7.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagattttgcagtttattattgtcagcagtataataactggcctccgtggacgttcggccaagggaccaaggtggaaatcaaacgaactgtggctgcaccatctgtcttcta

SEQ ID NO: 563936 - DNA, 504 bp, Homo sapiens
  misc_feature: HIJSMM301D0Y7X.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccca

SEQ ID NO: 563937 - DNA, 445 bp, Homo sapiens
  misc_feature: HIJSMM301BRSBX.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccgccctcctccactactatg

SEQ ID NO: 563938 - DNA, 491 bp, Homo sapiens
  misc_feature: HIJSMM301BHJ3J.52.54.E10.1.454.light.4.raw
cgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccac

SEQ ID NO: 563939 - DNA, 510 bp, Homo sapiens
  misc_feature: HIJSMM301AKLYB.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagtattttgcagtttattactgtcaacagcgtagcagcaggcctccggcgacgttcggccaagggaccaaggtggaagtcaagcgaactgtggctgcaccatctgtcttctatcttcccgcc

SEQ ID NO: 563940 - DNA, 447 bp, Homo sapiens; identical to SEQ ID NO: 535882
  misc_feature: HIJSMM301DO2IH.18.9.A09.1.454.light.4.raw
  modified_base (429)..(429): a, c, t, g, unknown or other

SEQ ID NO: 563941 - DNA, 495 bp, Homo sapiens; identical to SEQ ID NO: 536931
  misc_feature: HIJSMM301CU8Z6.10.33.C11.1.454.light.4.raw

SEQ ID NO: 563942 - DNA, 517 bp, Homo sapiens; identical to SEQ ID NO: 535261
  misc_feature: HIJSMM301AQ7LL.19.80.H03.1.454.light.4.raw

SEQ ID NO: 563943 - DNA, 521 bp, Homo sapiens; identical to SEQ ID NO: 539470
  misc_feature: HIJSMM301D3OZ0.27.23.C01.1.454.light.4.raw

SEQ ID NO: 563944 - DNA, 497 bp, Homo sapiens; identical to SEQ ID NO: 536371
  misc_feature: HIJSMM301A6FVN.16.78.H01.1.454.light.4.raw

SEQ ID NO: 563945 - DNA, 484 bp, Homo sapiens; identical to SEQ ID NO: 535211
  misc_feature: HIJSMM301CC1GQ.47.46.E02.1.454.light.4.raw

SEQ ID NO: 563946 - DNA, 508 bp, Homo sapiens
  misc_feature: HIJSMM301DQGLZ.11.57.F02.1.454.light.4.raw
cgagagataccacgaccggtgctcgatttagctcgatatagttgggtttgggggaggaactgctcagttaggatccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 563947 - DNA, 508 bp, Homo sapiens; identical to SEQ ID NO: 561979
  misc_feature: HIJSMM301A7DAB.47.85.H08.1.454.light.4.raw

SEQ ID NO: 563948 - DNA, 497 bp, Homo sapiens
  misc_feature: HIJSMM301A8T4G.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactcttcggcatccgcagcctgcagcctgaagattttgcgacatattactgtcaacagtatgaaaatgtcccgctcactttcggcgggggaccgaaggtggagttcaaacgaaactgtggctgcaccatctgtcttcatt

SEQ ID NO: 563949 - DNA, 496 bp, Homo sapiens
  misc_feature: HIJSMM301CP6LY.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctg

SEQ ID NO: 563950 - DNA, 520 bp, Homo sapiens
  misc_feature: HIJSMM301DYIDW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 563951 - DNA, 501 bp, Homo sapiens
  misc_feature: HIJSMM301CJ8C1.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtcctaggtcagcccaaggccaacccactgtc

SEQ ID NO: 563952 - DNA, 499 bp, Homo sapiens
  misc_feature: HIJSMM301DP26B.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 563953 - DNA, 460 bp, Homo sapiens; identical to SEQ ID NO: 536053
  misc_feature: HIJSMM301CQMC4.22.28.C06.1.454.light.4.raw

SEQ ID NO: 563954 - DNA, 506 bp, Homo sapiens
  misc_feature: HIJSMM301ALN52.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggaggatcaacgaaactgtggctgcaccatctgtcttcatcttcccgccat

SEQ ID NO: 563955 - DNA, 512 bp, Homo sapiens
  misc_feature: HIJSMM301D2KZ4.17.31.C09.1.454.light.4.raw
cgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaagctgccctgaccctttcgggtgcgcagcctgaggatgaggctgagtattactgcttgctctcctatagtggtgttcgggtgttcggcggagggaccaagctgaccgtcctaggtcagcccg

SEQ ID NO: 563956 - DNA, 444 bp, Homo sapiens; identical to SEQ ID NO: 534993
  misc_feature: HIJSMM301C1S4G.5.9.A09.1.454.light.4.raw

SEQ ID NO: 563957 - DNA, 486 bp, Homo sapiens; identical to SEQ ID NO: 537617
  misc_feature: HIJSMM301B3KRC.10.53.E09.1.454.light.4.raw

SEQ ID NO: 563958 - DNA, 442 bp, Homo sapiens
  misc_feature: HIJSMM301CNP20.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctgttcccgccctcctcgtatctctcg

SEQ ID NO: 563959 - DNA, 527 bp, Homo sapiens
  misc_feature: HIJSMM301BE8H3.52.62.F07.1.454.light.4.raw
cgcagtacgacacgaccggtgctcgatttagtagtcgcataaagggaaaggggtgggcctaaggaagcagcactggtggtgcctcagccatggcctggaccgttctcctcctcggcctcctctctcactgcacaggctctgtggcctcctctgtggtgacacagccaccctcggtgtctgtggccccgggaaagacggcctcaataacctgtgagagagacaacattgaaagaagacatgtacactggtaccagctgaggcccggccaggcccccagattggtcctctataatgatgacgaccggccctcagggatccctgagcgcttttctggctccaattctgggaacacggctaccctgaccatcactagggtcgaagccggggacgaggccgactattactgtcaggtgtgggatagtaatactgatcaatatgtcttcggaactgggaccacggtcaccgtcctaagtcagcccaaggccaaccccactgtcactctgttcccaccctcctctatacgatcg

SEQ ID NO: 563960 - DNA, 460 bp, Homo sapiens; identical to SEQ ID NO: 537107
  misc_feature: HIJSMM301CXXZY.22.28.C06.1.454.light.4.raw

SEQ ID NO: 563961 - DNA, 496 bp, Homo sapiens
  misc_feature: HIJSMM301BC4UL.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaaggctgccccctc

SEQ ID NO: 563962 - DNA, 474 bp, Homo sapiens
  misc_feature: HIJSMM301AG535.9.15.B04.1.454.light.4.raw
tgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagcctccctgaccatcagtgaattgcagactgaggatgaggctaactactactgccagtcctccgacagcagcctgggtgtttgggtgttcgggcggac

SEQ ID NO: 563963 - DNA, 490 bp, Homo sapiens; identical to SEQ ID NO: 535234
  misc_feature: HIJSMM301CRFKP.17.21.B10.1.454.light.4.raw

SEQ ID NO: 563964 - DNA, 498 bp, Homo sapiens; identical to SEQ ID NO: 544837
  misc_feature: HIJSMM301C0F4Z.11.71.G05.1.454.light.4.raw

SEQ ID NO: 563965 - DNA, 501 bp, Homo sapiens
  misc_feature: HIJSMM301AYRTP.16.72.G06.1.454.light.4.raw
tgtactactccacgaccggtgctcgatttagctacgactgcaagggaaaggggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagtattttgctagtttattactgtcagcagtataataactggcctccggtctactttcggcggagggaccgaaggtggagatacaaacgaactgtggctgcaccactcttcg

SEQ ID NO: 563966 - DNA, 502 bp, Homo sapiens
  misc_feature: HIJSMM301D7E8M.51.37.D04.1.454.light.4.raw
cgatcgtatacacgaccggtgctcgatttagtagcatactgttgggtttgggggctgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctcggtcact

SEQ ID NO: 563967 - DNA, 480 bp, Homo sapiens
  misc_feature: HIJSMM301AJ1WS.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcagcagtctgcagtctgaagattttgcagtttattactgtcagcagtataataactggcctccgtacatgtacacttttggccaggggaccaacctggagatcagacg

SEQ ID NO: 563968 - DNA, 496 bp, Homo sapiens
  misc_feature: HIJSMM301BFW2S.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctc

SEQ ID NO: 563969 - DNA, 507 bp, Homo sapiens; identical to SEQ ID NO: 540930
  misc_feature: HIJSMM301CECYN.8.34.D01.1.454.light.4.raw

SEQ ID NO: 563970 - DNA, 377 bp, Homo sapiens; identical to SEQ ID NO: 536071
  misc_feature: HIJSMM301BS25W.40.9.A09.1.454.light.4.raw

SEQ ID NO: 563971 - DNA, 489 bp, Homo sapiens; identical to SEQ ID NO: 543840
  misc_feature: HIJSMM301DHGYT.12.88.H11.1.454.light.4.raw

SEQ ID NO: 563972 - DNA, 501 bp, Homo sapiens; identical to SEQ ID NO: 539940
  misc_feature: HIJSMM301ALXDZ.5.24.C02.1.454.light.4.raw

SEQ ID NO: 563973 - DNA, 496 bp, Homo sapiens; identical to SEQ ID NO: 537925
  misc_feature: HIJSMM301DU94E.22.14.B03.1.454.light.4.raw

SEQ ID NO: 563974 - DNA, 498 bp, Homo sapiens
  misc_feature: HIJSMM301BCZ9V.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatacaaacgaaactgtggctgcaccatctgtctt

SEQ ID NO: 563975 - DNA, 480 bp, Homo sapiens
  misc_feature: HIJSMM301B4RI5.51.41.D08.1.454.light.4.raw
cgatcgtatacacgaccggtgctcgatttagtcacgcgagaaagggaaaggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactattgtcaacagagtttcaattcccctcgcacgttcggccaagggaccaaggtggaaatcaaacgaactgtggctgcaccat

SEQ ID NO: 563976 - DNA, 447 bp, Homo sapiens; identical to SEQ ID NO: 535201
  misc_feature: HIJSMM301DRMT3.18.9.A09.1.454.light.4.raw

SEQ ID NO: 563977 - DNA, 488 bp, Homo sapiens; identical to SEQ ID NO: 541987
  misc_feature: HIJSMM301CX3IC.8.12.B01.1.454.light.4.raw

SEQ ID NO: 563978 - DNA, 502 bp, Homo sapiens; identical to SEQ ID NO: 547421
  misc_feature: HIJSMM301BPMIA.51.5.A05.1.454.light.4.raw

SEQ ID NO: 563979 - DNA, 484 bp, Homo sapiens; identical to SEQ ID NO: 535400
  misc_feature: HIJSMM301D8TAJ.46.26.C04.1.454.light.4.raw

SEQ ID NO: 563980 - DNA, 505 bp, Homo sapiens
  misc_feature: HIJSMM301B47EJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactagtggcgtgcgaccatctgtcttcatcttccccg

SEQ ID NO: 563981 - DNA, 509 bp, Homo sapiens; identical to SEQ ID NO: 539138
  misc_feature: HIJSMM301DY04Z.17.33.C11.1.454.light.4.raw

SEQ ID NO: 563982 - DNA, 486 bp, Homo sapiens; identical to SEQ ID NO: 536329
  misc_feature: HIJSMM301CRYJ6.21.4.A04.1.454.light.4.raw

SEQ ID NO: 563983 - DNA, 494 bp, Homo sapiens; identical to SEQ ID NO: 535276
  misc_feature: HIJSMM301BRR10.16.6.A06.1.454.light.4.raw

SEQ ID NO: 563984 - DNA, 489 bp, Homo sapiens; identical to SEQ ID NO: 549568
  misc_feature: HIJSMM301DZT9S.43.33.C11.1.454.light.4.raw

SEQ ID NO: 563985 - DNA, 499 bp, Homo sapiens; identical to SEQ ID NO: 537739
  misc_feature: HIJSMM301BTWEL.12.86.H09.1.454.light.4.raw

SEQ ID NO: 563986 - DNA, 486 bp, Homo sapiens
  misc_feature: HIJSMM301CZEWA.4.51.E07.1.454.light.4.raw
agcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagattttggagtttattactgtcagcagtataataactggcctctcactttcggcggagggaccgaaggtggagatcaaacgaactgtggctgcac

SEQ ID NO: 563987 - DNA, 506 bp, Homo sapiens; identical to SEQ ID NO: 555381
  misc_feature: HIJSMM301DSTH8.4.21.B10.1.454.light.4.raw

SEQ ID NO: 563988 - DNA, 485 bp, Homo sapiens; identical to SEQ ID NO: 560039
  misc_feature: HIJSMM301EHIDA.41.54.E10.1.454.light.4.raw

SEQ ID NO: 563989 - DNA, 482 bp, Homo sapiens
  misc_feature: HIJSMM301DMVP3.49.38.D05.1.454.light.4.raw
agtcgagagacacgaccggtgctcgatttagtatctgatagttgggtttggggagtcccaaccaggacacagcatggacatgagggtccctgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaaagctggagatcacacgaactgtggctgcaccatct

SEQ ID NO: 563990 - DNA, 461 bp, Homo sapiens
  misc_feature: HIJSMM301AJBNA.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctggaccagagtggacatgaacgaa

SEQ ID NO: 563991 - DNA, 513 bp, Homo sapiens
  misc_feature: HIJSMM301B3HM3.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaacggccaaccccactgtcactctcg

SEQ ID NO: 563992 - DNA, 443 bp, Homo sapiens
  misc_feature: HIJSMM301DMIDF.5.9.A09.1.454.light.4.raw
  modified_base (340)..(340): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacngtttgggtgtttgggtgttcggcggagggaccaagctgaccgtctaagtcagcccaaggctgccccctcggtcactctgttcccaccctcctccgtgtctgat

SEQ ID NO: 563993 - DNA, 490 bp, Homo sapiens
  misc_feature: HIJSMM301CCU1W.4.24.C02.1.454.light.4.raw
agcactgtagcacgaccggtgctcgatttagtacagatcgttagggaaaggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtggctgcaccatctgtcttcta

SEQ ID NO: 563994 - DNA, 489 bp, Homo sapiens
  misc_feature: HIJSMM301DYXVC.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagaccaaacgaactgtggctgcaccatctgtcttcat

SEQ ID NO: 563995 - DNA, 495 bp, Homo sapiens; identical to SEQ ID NO: 539061
  misc_feature: HIJSMM301C6O0Z.22.27.C05.1.454.light.4.raw

SEQ ID NO: 563996 - DNA, 505 bp, Homo sapiens
  misc_feature: HIJSMM301BSP5Y.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtctac

SEQ ID NO: 563997 - DNA, 514 bp, Homo sapiens; identical to SEQ ID NO: 544242
  misc_feature: HIJSMM301AZ0CJ.43.23.C01.1.454.light.4.raw

SEQ ID NO: 563998 - DNA, 509 bp, Homo sapiens; identical to SEQ ID NO: 539359
  misc_feature: HIJSMM301C9PV5.47.85.H08.1.454.light.4.raw

SEQ ID NO: 563999 - DNA, 513 bp, Homo sapiens
  misc_feature: HIJSMM301CWBRQ.43.12.B01.1.454.light.4.raw
tgtgagtagtcacgaccggtgctcgatttagtagtgtagattcgctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactact

SEQ ID NO: 564000 - DNA, 454 bp, Homo sapiens; identical to SEQ ID NO: 535005
  misc_feature: HIJSMM301EUT6E.19.86.H09.1.454.light.4.raw

SEQ ID NO: 564001 - DNA, 495 bp, Homo sapiens; identical to SEQ ID NO: 535596
  misc_feature: HIJSMM301C50LL.10.79.H02.1.454.light.4.raw

SEQ ID NO: 564002 - DNA, 494 bp, Homo sapiens
  misc_feature: HIJSMM301B9K54.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggttattactgcatgcaagttctacaaacttcctacacttttggccaggggaccaagctggagatcaaacgaactgtggctgca

SEQ ID NO: 564003 - DNA, 490 bp, Homo sapiens; identical to SEQ ID NO: 541141
  misc_feature: HIJSMM301CYGO2.47.38.D05.1.454.light.4.raw

SEQ ID NO: 564004 - DNA, 511 bp, Homo sapiens
  misc_feature: HIJSMM301C23UU.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccacttgactatcactggggcccaggtggaggatgaaggtgactacttctgtttctcaacagacaccagtgacaatcatgcgattttcggcggagggaccaagctgaccgtcctgggtcagcccaaggctcgcccctcggtcactctgttccccg

SEQ ID NO: 564005 - DNA, 506 bp, Homo sapiens
  misc_feature: HIJSMM301DPFT2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggagtatcaaacgaactgtggctgcaccatctgtctt

SEQ ID NO: 564006 - DNA, 376 bp, Homo sapiens
  misc_feature: HIJSMM301E0CTP.49.70.G04.1.454.light.4.raw
agtcgagagacacgaccggtgctcgatttagtgtagtgtgaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccgccctcctcttctcgact

SEQ ID NO: 564007 - DNA, 499 bp, Homo sapiens; identical to SEQ ID NO: 537739
  misc_feature: HIJSMM301DELXV.12.86.H09.1.454.light.4.raw

SEQ ID NO: 564008 - DNA, 475 bp, Homo sapiens; identical to SEQ ID NO: 544617
  misc_feature: HIJSMM301DQHP8.13.76.G10.1.454.light.4.raw

SEQ ID NO: 564009 - DNA, 503 bp, Homo sapiens
  misc_feature: HIJSMM301DX1AT.48.31.C09.1.454.light.4.raw
agtatacatacacgaccggtgctcgatttagacgtctcatcaaggaaggaaggggcagtctcagtcaggacacagcatggacatcgagggtccccgctcagctcctggggctcctgctactctggctccgtaggtgccagatgtgacatccagctgacccagtctccatcctccctgtctgcttcgtgtgggagaccagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaactacttctgtcaccaggcttacaattcccctcgacgttcggccaagggaccaaggtggaagtcagacgaactgtggactgcaccatctgtcttcatcttccccg

SEQ ID NO: 564010 - DNA, 501 bp, Homo sapiens; identical to SEQ ID NO: 535746
  misc_feature: HIJSMM301E0P1E.18.11.A11.1.454.light.4.raw

SEQ ID NO: 564011 - DNA, 515 bp, Homo sapiens
  misc_feature: HIJSMM301EQZ3O.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctccggtcactctcgttcccaccctcctcacta

SEQ ID NO: 564012 - DNA, 490 bp, Homo sapiens
  misc_feature: HIJSMM301DBKQH.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgttcggccaggggaccaaggtggaagtcaagcgaactgtggctgcaccatctgtt

SEQ ID NO: 564013 - DNA, 495 bp, Homo sapiens; identical to SEQ ID NO: 535596
  misc_feature: HIJSMM301EHUJV.10.79.H02.1.454.light.4.raw

SEQ ID NO: 564014 - DNA, 495 bp, Homo sapiens
  misc_feature: HIJSMM301ARUN4.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtactgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttc

SEQ ID NO: 564015 - DNA, 509 bp, Homo sapiens
  misc_feature: HIJSMM301ASO70.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaaacctagtggcgtgcaccactctgtcttcatcttccccg

SEQ ID NO: 564016 - DNA, 501 bp, Homo sapiens; identical to SEQ ID NO: 536867
  misc_feature: HIJSMM301AD6XD.5.86.H09.1.454.light.4.raw

SEQ ID NO: 564017 - DNA, 493 bp, Homo sapiens
  misc_feature: HIJSMM301DWAVA.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaacgtggatttcagacgaactgtggctgcaccatctgtcttcta

SEQ ID NO: 564018 - DNA, 504 bp, Homo sapiens; identical to SEQ ID NO: 538423
  misc_feature: HIJSMM301D2563.48.67.G01.1.454.light.4.raw

SEQ ID NO: 564019 - DNA, 506 bp, Homo sapiens; identical to SEQ ID NO: 534969
  misc_feature: HIJSMM301EEJ55.18.37.D04.1.454.light.4.raw

SEQ ID NO: 564020 - DNA, 486 bp, Homo sapiens; identical to SEQ ID NO: 535043
  misc_feature: HIJSMM301B02A6.46.35.D02.1.454.light.4.raw

SEQ ID NO: 564021 - DNA, 496 bp, Homo sapiens; identical to SEQ ID NO: 548177
  misc_feature: HIJSMM301AHLHU.18.59.F04.1.454.light.4.raw

SEQ ID NO: 564022 - DNA, 488 bp, Homo sapiens
  misc_feature: HIJSMM301BEY54.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttcgtggacgttcggccaagggaccaaggtggagtatcagacgaa

SEQ ID NO: 564023 - DNA, 494 bp, Homo sapiens
  misc_feature: HIJSMM301EJPOU.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcatatttcgtgctccgtacacttttggccaggggacccaggtggaggatcagacgaactgtggctgcaccatctgtcttcatcttcccg

SEQ ID NO: 564024 - DNA, 495 bp, Homo sapiens; identical to SEQ ID NO: 535486
  misc_feature: HIJSMM301AK9JQ.26.72.G06.1.454.light.4.raw

SEQ ID NO: 564025 - DNA, 493 bp, Homo sapiens; identical to SEQ ID NO: 542591
  misc_feature: HIJSMM301DK3DL.9.1.A01.1.454.light.4.raw

SEQ ID NO: 564026 - DNA, 498 bp, Homo sapiens
  misc_feature: HIJSMM301AU9OF.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggtcgggggaccgaaggtggagttcaaacgaactagtggctgcaccatctgtcttcatt

SEQ ID NO: 564027 - DNA, 524 bp, Homo sapiens
  misc_feature: HIJSMM301CLQ9J.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttaccgtccccgtggacgttcggccgagggaccaaggtggcaatcaaccgaactgtggctgcaccatctgtcttcattccttccccg

SEQ ID NO: 564028 - DNA, 509 bp, Homo sapiens; identical to SEQ ID NO: 547321
  misc_feature: HIJSMM301D7H0N.4.57.F02.1.454.light.4.raw

SEQ ID NO: 564029 - DNA, 447 bp, Homo sapiens; identical to SEQ ID NO: 535020
  misc_feature: HIJSMM301BOVQQ.18.9.A09.1.454.light.4.raw

SEQ ID NO: 564030 - DNA, 488 bp, Homo sapiens
  misc_feature: HIJSMM301DXTEK.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagtttattactgtcagcagtatcataactggccgctccaccttcggccaagggacacgactggagattaaacgaactgtggctgcaccat

SEQ ID NO: 564031 - DNA, 490 bp, Homo sapiens; identical to SEQ ID NO: 541141
  misc_feature: HIJSMM301ENKPN.47.38.D05.1.454.light.4.raw

SEQ ID NO: 564032 - DNA, 495 bp, Homo sapiens; identical to SEQ ID NO: 543094
  misc_feature: HIJSMM301AFOCX.22.57.F02.1.454.light.4.raw

SEQ ID NO: 564033 - DNA, 448 bp, Homo sapiens
  misc_feature: HIJSMM301BMAT3.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactaggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 564034 - DNA, 447 bp, Homo sapiens; identical to SEQ ID NO: 552177
  misc_feature: HIJSMM301BOENB.18.9.A09.1.454.light.4.raw

SEQ ID NO: 564035 - DNA, 504 bp, Homo sapiens; identical to SEQ ID NO: 551788
  misc_feature: HIJSMM301CJVHE.12.53.E09.1.454.light.4.raw

SEQ ID NO: 564036 - DNA, 484 bp, Homo sapiens; identical to SEQ ID NO: 538367
  misc_feature: HIJSMM301EGL8N.8.14.B03.1.454.light.4.raw

SEQ ID NO: 564037 - DNA, 484 bp, Homo sapiens; identical to SEQ ID NO: 535498
  misc_feature: HIJSMM301DWI6Q.47.62.F07.1.454.light.4.raw

SEQ ID NO: 564038 - DNA, 478 bp, Homo sapiens; identical to SEQ ID NO: 541146
  misc_feature: HIJSMM301D4JS0.21.25.C03.1.454.light.4.raw

SEQ ID NO: 564039 - DNA, 516 bp, Homo sapiens
  misc_feature: HIJSMM301DF8NK.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaacggtaggagagtacaaacgaacgtagtggctgcaccatctgtcttcta

SEQ ID NO: 564040 - DNA, 504 bp, Homo sapiens
  misc_feature: HIJSMM301EQHRP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggccaagctgaccgtcctgggtcagcccaaggcctgccccctcggtcta

SEQ ID NO: 564041 - DNA, 513 bp, Homo sapiens
  misc_feature: HIJSMM301ER32Z.16.66.F11.1.454.light.4.raw
  modified_base (354)..(354): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagcccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctnaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 564042 - DNA, 494 bp, Homo sapiens; identical to SEQ ID NO: 534994
  misc_feature: HIJSMM301EI2PY.27.78.H01.1.454.light.4.raw

SEQ ID NO: 564043 - DNA, 506 bp, Homo sapiens
  misc_feature: HIJSMM301DYA9P.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgctagtttattactgtcagcagcggggcaattggccgctcacgtttcgggcgggggaccgaaggtggagttacaacgaactgtggctgcaccatctgtcttcatccttcccg

SEQ ID NO: 564044 - DNA, 490 bp, Homo sapiens; identical to SEQ ID NO: 539196
  misc_feature: HIJSMM301BDM7T.22.65.F10.1.454.light.4.raw

SEQ ID NO: 564045 - DNA, 491 bp, Homo sapiens
  misc_feature: HIJSMM301EATH5.4.20.B09.1.454.light.4.raw
agcactgtagcacgaccggtgctcgatttagtgtagtgtgaagggggagctacaacaggcaggcaggggcagcaagatggtgttgcagacccaggtcttcatttctctgttgctctggatctctggtgcctacggggacatcgtgatgacccagtctccggactccctggctgtgtctctgggcgagagggccaccatcaactgcaagtccagccagagtgttttatacaactccaacaataagaactacttagcttggtaccagcagagaccaggacagcctcctaagctgctcatttactgggcatctacccgggaatccggggtccctgaccgattcagtggcagcgggtctgggacagatttcactctcgccatcagcagcctgcagcctgacgatgtggcagtttattactgccagcaatattatactgacccgtggacgttcggccaagggaccaaggtgaaatcaaacgaactgtggctgcacc

SEQ ID NO: 564046 - DNA, 496 bp, Homo sapiens; identical to SEQ ID NO: 559406
  misc_feature: HIJSMM301A1MK9.51.39.D06.1.454.light.4.raw

SEQ ID NO: 564047 - DNA, 476 bp, Homo sapiens; identical to SEQ ID NO: 537368
  misc_feature: HIJSMM301AM66E.7.83.H06.1.454.light.4.raw

SEQ ID NO: 564048 - DNA, 492 bp, Homo sapiens; identical to SEQ ID NO: 537509
  misc_feature: HIJSMM301C9R01.13.46.E02.1.454.light.4.raw

SEQ ID NO: 564049 - DNA, 474 bp, Homo sapiens
  misc_feature: HIJSMM301EWFFC.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctggacgttcggccaaggaccaaggtaggaaagtacaaacgaa

SEQ ID NO: 564050 - DNA, 494 bp, Homo sapiens
  misc_feature: HIJSMM301BI7XW.43.45.E01.1.454.light.4.raw
tgtgagtagtcacgaccggtgctcgatttagtgagtcagtaagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggaccgttcggtccgacgggaccgacggtcggtagtgtcaagacgaactagtggcgtgcaccat

SEQ ID NO: 564051 - DNA, 499 bp, Homo sapiens; identical to SEQ ID NO: 547972
  misc_feature: HIJSMM301AXY48.8.2.A02.1.454.light.4.raw

SEQ ID NO: 564052 - DNA, 497 bp, Homo sapiens
  misc_feature: HIJSMM301DPK6Y.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttaggcagcaactacgttgcctggtaccaacagaaacctggccaggctcccgggctcctcatctatggtacatctagcagggccactggcatcccagacaggttcagtggcagtgggtctgggacaggacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 564053 - DNA, 489 bp, Homo sapiens; identical to SEQ ID NO: 541702
  misc_feature: HIJSMM301EN093.10.72.G06.1.454.light.4.raw

SEQ ID NO: 564054 - DNA, 506 bp, Homo sapiens
  misc_feature: HIJSMM301BLMP2.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgtcctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttctaagttcctttttgttcttcggaactgggaccgaggtcaccgtcctaggtcagcccaaggccaaccccactgtcta

SEQ ID NO: 564055 - DNA, 486 bp, Homo sapiens; identical to SEQ ID NO: 535043
  misc_feature: HIJSMM301AYUZU.46.35.D02.1.454.light.4.raw

SEQ ID NO: 564056 - DNA, 522 bp, Homo sapiens; identical to SEQ ID NO: 540226
  misc_feature: HIJSMM301CJ1VU.27.23.C01.1.454.light.4.raw

SEQ ID NO: 564057 - DNA, 509 bp, Homo sapiens
  misc_feature: HIJSMM301DP88F.10.71.G05.1.454.light.4.raw
catagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccaaaatagaggtcaaacgaaactgtggctgcaccatctgtcttcatcttccccg

SEQ ID NO: 564058 - DNA, 484 bp, Homo sapiens; identical to SEQ ID NO: 535441
  misc_feature: HIJSMM301AKH5L.26.60.F05.1.454.light.4.raw

SEQ ID NO: 564059 - DNA, 507 bp, Homo sapiens
  misc_feature: HIJSMM301AF1ZC.7.31.C09.1.454.light.4.raw
cgtgtctctacacgaccggtgctcgatttagacgtctcatcaaggaaggaaggggggggtcgtcaggagggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcgggcggagggaccaagctgaccgtcctaggtcagcccaaggctcgccccctc

SEQ ID NO: 564060 - DNA, 481 bp, Homo sapiens; identical to SEQ ID NO: 545581
  misc_feature: HIJSMM301D4DYY.48.19.B08.1.454.light.4.raw

SEQ ID NO: 564061 - DNA, 505 bp, Homo sapiens; identical to SEQ ID NO: 536437
  misc_feature: HIJSMM301BF62E.18.37.D04.1.454.light.4.raw

SEQ ID NO: 564062 - DNA, 434 bp, Homo sapiens; identical to SEQ ID NO: 535153
  misc_feature: HIJSMM301DNJBG.18.5.A05.1.454.light.4.raw

SEQ ID NO: 564063 - DNA, 499 bp, Homo sapiens
  misc_feature: HIJSMM301CG0L9.52.53.E09.1.454.light.4.raw
cgcagtacgacacgaccggtgctcgatttagagagagtgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 564064 - DNA, 498 bp, Homo sapiens; identical to SEQ ID NO: 538056
  misc_feature: HIJSMM301ES56C.15.25.C03.1.454.light.4.raw

SEQ ID NO: 564065 - DNA, 508 bp, Homo sapiens
  misc_feature: HIJSMM301CE13X.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgcctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctcgccccctcggtcactctcgttcccaccct

SEQ ID NO: 564066 - DNA, 486 bp, Homo sapiens
  misc_feature: HIJSMM301C1N8A.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctaccgtaga

SEQ ID NO: 564067 - DNA, 498 bp, Homo sapiens
  misc_feature: HIJSMM301BFQXG.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcgagtggagtcaggcacagattttacgtctgaaaatacagtagggtggaggctgaggatgttggggtttagttacttgcatgcaagttctacaaacttccttacacttttggtccaggggaccgaagctggaggatcaaacgaaa

SEQ ID NO: 564068 - DNA, 497 bp, Homo sapiens; identical to SEQ ID NO: 536371
  misc_feature: HIJSMM301EL4E9.16.78.H01.1.454.light.4.raw

SEQ ID NO: 564069 - DNA, 484 bp, Homo sapiens; identical to SEQ ID NO: 535400
  misc_feature: HIJSMM301C2VG4.46.26.C04.1.454.light.4.raw

SEQ ID NO: 564070 - DNA, 484 bp, Homo sapiens
  misc_feature: HIJSMM301D4OQ1.52.22.B11.1.454.light.4.raw
cgcagtacgacacgaccggtgctcgatttagacgacagctcaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtgggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtctt

SEQ ID NO: 564071 - DNA, 493 bp, Homo sapiens; identical to SEQ ID NO: 535047
  misc_feature: HIJSMM301DBWWH.16.53.E09.1.454.light.4.raw

SEQ ID NO: 564072 - DNA, 495 bp, Homo sapiens
  misc_feature: HIJSMM301A4QT0.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggccaggggaccaagctagaaatcaaacgaactgtggctgcaccatctgtcttcta

SEQ ID NO: 564073 - DNA, 441 bp, Homo sapiens; identical to SEQ ID NO: 534971
  misc_feature: HIJSMM301BX2X9.11.3.A03.1.454.light.4.raw

SEQ ID NO: 564074 - DNA, 502 bp, Homo sapiens
  misc_feature: HIJSMM301BDVDI.9.81.H04.1.454.light.4.raw
tgatacgtctcacgaccggtgctcgatttagtagtgtagattcgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcact

SEQ ID NO: 564075 - DNA, 492 bp, Homo sapiens
  misc_feature: HIJSMM301BULRS.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtctaggtcagcccaaggctgccccctcggtcactctgttcccg

SEQ ID NO: 564076 - DNA, 512 bp, Homo sapiens; identical to SEQ ID NO: 539813
  misc_feature: HIJSMM301DTT71.14.7.A07.1.454.light.4.raw

SEQ ID NO: 564077 - DNA, 493 bp, Homo sapiens; identical to SEQ ID NO: 535084
  misc_feature: HIJSMM301AOHAG.47.64.F09.1.454.light.4.raw

SEQ ID NO: 564078 - DNA, 485 bp, Homo sapiens; identical to SEQ ID NO: 536075
  misc_feature: HIJSMM301DHPBG.17.21.B10.1.454.light.4.raw

SEQ ID NO: 564079 - DNA, 485 bp, Homo sapiens
  misc_feature: HIJSMM301B4NYR.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaacagggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtctt

SEQ ID NO: 564080 - DNA, 493 bp, Homo sapiens; identical to SEQ ID NO: 535047
  misc_feature: HIJSMM301B44BX.16.53.E09.1.454.light.4.raw

SEQ ID NO: 564081 - DNA, 518 bp, Homo sapiens; identical to SEQ ID NO: 543797
  misc_feature: HIJSMM301DUMBU.19.80.H03.1.454.light.4.raw

SEQ ID NO: 564082 - DNA, 505 bp, Homo sapiens; identical to SEQ ID NO: 536232
  misc_feature: HIJSMM301EVXH2.47.65.F10.1.454.light.4.raw

SEQ ID NO: 564083 - DNA, 487 bp, Homo sapiens
  misc_feature: HIJSMM301CCHLA.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtgaggtcaacgaactgtggctgcaccatctgtcttcat

SEQ ID NO: 564084 - DNA, 503 bp, Homo sapiens; identical to SEQ ID NO: 538884
  misc_feature: HIJSMM301B4YO0.27.78.H01.1.454.light.4.raw

SEQ ID NO: 564085 - DNA, 503 bp, Homo sapiens
  misc_feature: HIJSMM301A8F2G.43.34.D01.1.454.light.4.raw
tgtgagtagtcacgaccggtgctcgattagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttcttatcgcttctctggctccaagtctggcaacacggcctccctgaccatctctgggctccaggctgaggacgaggctgattattactgcaactcacttacaacgaccgacacttgcgtattcggcgcgggaccaagctgaccgtcctaggtcagcccaaggctgccccctcggtca

SEQ ID NO: 564086 - DNA, 467 bp, Homo sapiens; identical to SEQ ID NO: 535997
  misc_feature: HIJSMM301ETRBM.5.36.D03.1.454.light.4.raw

SEQ ID NO: 564087 - DNA, 517 bp, Homo sapiens
  misc_feature: HIJSMM301C7D3W.43.81.H04.1.454.light.4.raw
tgtgagtagtcacgaccggtgctcgatttagtagtgtagattcgcgggtctggcgccaggggtcccttccaatatcagcaccatggcctggactcctctctttctgttcctcctcacttgctgcccagggtccaattctcagactgcggtgactcaggagccctcactgactgtgtccccaggagggacagttactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctcactttcgtactgcctgggtcttcggcgggggacgtcagttgaccgtcctaggtcagcccaaggctgccccctcggtcactctgttcccaccctcctcactact

SEQ ID NO: 564088 - DNA, 511 bp, Homo sapiens
  misc_feature: HIJSMM301AV7RW.11.57.F02.1.454.light.4.raw
  modified_base (459)..(459): a, c, t, g, unknown or other
cgagagataccacgaccggtgctcgatttagctcgatatagttggggtttgggggaggaactgctcagttaggacccagagggaaccatggaacgccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagttttattactgtcaacagcgtagcagcaggcctccggcgacgttcgccaggaccaggnggagtcaagcgaactgtggctgcaccatctgtcttcactcttcccgccactt

SEQ ID NO: 564089 - DNA, 493 bp, Homo sapiens
  misc_feature: HIJSMM301BIBPG.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatggttggggtttattactgcatgcaagctctacaaactccttacacttttggccaggggaccaagctggagatacaaacgaactgt

SEQ ID NO: 564090 - DNA, 502 bp, Homo sapiens; identical to SEQ ID NO: 558387
  misc_feature: HIJSMM301CQRMM.43.86.H09.1.454.light.4.raw

SEQ ID NO: 564091 - DNA, 497 bp, Homo sapiens
  misc_feature: HIJSMM301D6KHE.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcgtccaacggacaacggtaggacgatcaacgaactagtaggcgtcgtcaccactctgtctt

SEQ ID NO: 564092 - DNA, 476 bp, Homo sapiens; identical to SEQ ID NO: 547834
  misc_feature: HIJSMM301EDTK6.5.15.B04.1.454.light.4.raw

SEQ ID NO: 564093 - DNA, 510 bp, Homo sapiens
  misc_feature: HIJSMM301BW8VW.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggccccctctccctcactttcggcgggggaccaaggtggagctcaaacgaactgtggctgcaccatctgtcttcatcttcccg

SEQ ID NO: 564094 - DNA, 491 bp, Homo sapiens
  misc_feature: HIJSMM301CEGBK.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccactttcggcggagggaccagggtggacgtcaaacgaactgtggctgcaccatctgtcttcatt

SEQ ID NO: 564095 - DNA, 483 bp, Homo sapiens
  misc_feature: HIJSMM301E1HWG.48.34.D01.1.454.light.4.raw
  modified_base (430)..(430): a, c, t, g, unknown or other
agtatacatacacgaccggtgctcgatttagatcgtctgtgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttangatagtggcaataatgtttgggtgtttggcggagggaccaagctgaccgtcct

SEQ ID NO: 564096 - DNA, 478 bp, Homo sapiens; identical to SEQ ID NO: 535129
  misc_feature: HIJSMM301BVCDI.11.11.A11.1.454.light.4.raw

SEQ ID NO: 564097 - DNA, 493 bp, Homo sapiens; identical to SEQ ID NO: 540127
  misc_feature: HIJSMM301ELGXX.10.17.B06.1.454.light.4.raw

SEQ ID NO: 564098 - DNA, 479 bp, Homo sapiens
  misc_feature: HIJSMM301BVGRO.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacaccctgcgtggttttggctgttcggcggcggacc

SEQ ID NO: 564099 - DNA, 493 bp, Homo sapiens; identical to SEQ ID NO: 546762
  misc_feature: HIJSMM301CF620.26.12.B01.1.454.light.4.raw

SEQ ID NO: 564100 - DNA, 485 bp, Homo sapiens; identical to SEQ ID NO: 536040
  misc_feature: HIJSMM301BK9UC.15.1.A01.1.454.light.4.raw

SEQ ID NO: 564101 - DNA, 503 bp, Homo sapiens; identical to SEQ ID NO: 552891
  misc_feature: HIJSMM301DSXB3.21.22.B11.1.454.light.4.raw
  modified_base (430)..(430): a, c, t, g, unknown or other

SEQ ID NO: 564102 - DNA, 474 bp, Homo sapiens
  misc_feature: HIJSMM301CGOOD.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaacgctcctgatctatgctgcttccagtttgcaaagtggggtcccatcaaggttcagtggcagtggatctgggacagatttcactctcactgtcagcagtctgcaatttgaagattttgcaacttactactgtcaacagagtttcagtatcccttggacttcgtccgacggacgaacggtagaagtacaacgaac

SEQ ID NO: 564103 - DNA, 494 bp, Homo sapiens; identical to SEQ ID NO: 534994
  misc_feature: HIJSMM301DJIAF.27.78.H01.1.454.light.4.raw

SEQ ID NO: 564104 - DNA, 509 bp, Homo sapiens
  misc_feature: HIJSMM301EQGQ5.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgcccctcggtcactctgtcccg

SEQ ID NO: 564105 - DNA, 502 bp, Homo sapiens; identical to SEQ ID NO: 542039
  misc_feature: HIJSMM301B1OTZ.2.76.G10.1.454.light.4.raw

SEQ ID NO: 564106 - DNA, 507 bp, Homo sapiens
  misc_feature: HIJSMM301BH0ES.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccgtattcggcggaggaccaagctgaccgtcctcggtcagcccaaggctcgcccccg

SEQ ID NO: 564107 - DNA, 473 bp, Homo sapiens; identical to SEQ ID NO: 535262
  misc_feature: HIJSMM301AGNLV.8.67.G01.1.454.light.4.raw

SEQ ID NO: 564108 - DNA, 494 bp, Homo sapiens; identical to SEQ ID NO: 535497
  misc_feature: HIJSMM301B02GR.43.72.G06.1.454.light.4.raw

SEQ ID NO: 564109 - DNA, 497 bp, Homo sapiens; identical to SEQ ID NO: 536371
  misc_feature: HIJSMM301DPMFW.16.78.H01.1.454.light.4.raw

SEQ ID NO: 564110 - DNA, 500 bp, Homo sapiens; identical to SEQ ID NO: 544063
  misc_feature: HIJSMM301BD924.12.18.B07.1.454.light.4.raw

SEQ ID NO: 564111 - DNA, 498 bp, Homo sapiens
  misc_feature: HIJSMM301B7KQF.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgagattttgcagtttattactgtcagcagcgtagcaactggcctcggttcacttttggccaggggaccaagctggagatcaaacgaactgtggctgcaccatctgtcttcatt

SEQ ID NO: 564112 - DNA, 497 bp, Homo sapiens; identical to SEQ ID NO: 546781
  misc_feature: HIJSMM301EE55B.43.28.C06.1.454.light.4.raw

SEQ ID NO: 564113 - DNA, 498 bp, Homo sapiens
  misc_feature: HIJSMM301EERS2.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctccg

SEQ ID NO: 564114 - DNA, 499 bp, Homo sapiens; identical to SEQ ID NO: 542463
  misc_feature: HIJSMM301EJSBV.26.26.C04.1.454.light.4.raw

SEQ ID NO: 564115 - DNA, 501 bp, Homo sapiens
  misc_feature: HIJSMM301BUFKI.52.45.E01.1.454.light.4.raw
cgcagtacgacacgaccggtgctcgatttagtgagtcagtaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacacgcccccaaactcctcattctttggtaacagcaatcggccctccggggtccctgaccgattctctggctccaagtctggcacctcagcctccctggcccatcactgggctccaggctgaggatgaggctgattattactgccagtcctatgacagcagcctgagtgtcttttgggtcttcggaactgggaccaaggtcaccgtcctaggtcacg

SEQ ID NO: 564116 - DNA, 487 bp, Homo sapiens; identical to SEQ ID NO: 558003
  misc_feature: HIJSMM301BDZL5.47.70.G04.1.454.light.4.raw

SEQ ID NO: 564117 - DNA, 492 bp, Homo sapiens
  misc_feature: HIJSMM301CTMYO.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtagggtggaggctgaggatggttggggtttattactgcatgcaagttctacaaacttcctactacttttggccaggggaccaaagctggagatacaaacgaa

SEQ ID NO: 564118 - DNA, 524 bp, Homo sapiens
  misc_feature: HIJSMM301D845E.27.23.C01.1.454.light.4.raw
agcgtcgtctcacgaccggtgctcgatttagtacacgtgattagggattgggggggtctcaggaggcagcgctctcgggacgtctccaccttggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccaccctcct

SEQ ID NO: 564119 - DNA, 473 bp, Homo sapiens
  misc_feature: HIJSMM301DEHRY.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactgggtattcggcggagggaccaagctgaccgtcctaggtcagcccaagg

SEQ ID NO: 564120 - DNA, 527 bp, Homo sapiens
  misc_feature: HIJSMM301AP29V.22.27.C05.1.454.light.4.raw
  modified_base (423)..(423): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactntacagactaattattattacttccctcctcaacgtcggtccgaccggaacggaaccggtaaggaaggtaactaacgaaacgtaactaggtggctcgaccaccta

SEQ ID NO: 564121 - DNA, 493 bp, Homo sapiens
  misc_feature: HIJSMM301CUGUV.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgtcagtttattactgtcagcagcgtagcaactggctcatcacctcgtccacggacgacgactcggagagtagaaacgaacgtagtggtcgtgcacca

SEQ ID NO: 564122 - DNA, 521 bp, Homo sapiens; identical to SEQ ID NO: 536990
  misc_feature: HIJSMM301BY5RI.27.23.C01.1.454.light.4.raw
  modified_base (517)..(517): a, c, t, g, unknown or other

SEQ ID NO: 564123 - DNA, 485 bp, Homo sapiens; identical to SEQ ID NO: 544818
  misc_feature: HIJSMM301CNVQD.13.36.D03.1.454.light.4.raw

SEQ ID NO: 564124 - DNA, 416 bp, Homo sapiens; identical to SEQ ID NO: 539343
  misc_feature: HIJSMM301DIKTC.18.78.H01.1.454.light.4.raw

SEQ ID NO: 564125 - DNA, 553 bp, Homo sapiens
  misc_feature: HIJSMM301DX2G0.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccccctacccaacaacgcataagcgtcgctgccgcagcttcggtgcatggtttagccccgtttcatcttcccgccatctgactagtctacg

SEQ ID NO: 564126 - DNA, 511 bp, Homo sapiens
  misc_feature: HIJSMM301A7WOL.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggggtttattactgcatgcaagttctacaaaacttcctacacttttggtccacggggaccgaacgactggaggaatcaaaccgaaaacgtgttgggctg

SEQ ID NO: 564127 - DNA, 491 bp, Homo sapiens; identical to SEQ ID NO: 535294
  misc_feature: HIJSMM301D1J9X.16.68.G02.1.454.light.4.raw

SEQ ID NO: 564128 - DNA, 494 bp, Homo sapiens; identical to SEQ ID NO: 535276
  misc_feature: HIJSMM301AO87A.16.6.A06.1.454.light.4.raw

SEQ ID NO: 564129 - DNA, 485 bp, Homo sapiens
  misc_feature: HIJSMM301AYUEB.49.28.C06.1.454.light.4.raw
agtcgagagacacgaccggtgctcgatttagagctcacgtattgggtttgggggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccatctgtt

SEQ ID NO: 564130 - DNA, 502 bp, Homo sapiens; identical to SEQ ID NO: 544940
  misc_feature: HIJSMM301DE0RD.9.53.E09.1.454.light.4.raw

SEQ ID NO: 564131 - DNA, 513 bp, Homo sapiens
  misc_feature: HIJSMM301CVT9H.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 564132 - DNA, 509 bp, Homo sapiens; identical to SEQ ID NO: 543266
  misc_feature: HIJSMM301AGHXJ.17.33.C11.1.454.light.4.raw

SEQ ID NO: 564133 - DNA, 480 bp, Homo sapiens
  misc_feature: HIJSMM301CSUDZ.16.86.H09.1.454.light.4.raw
  modified_base (462)..(462): a, c, t, g, unknown or other
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctcgttcccnccctcctcgagtagtaca

SEQ ID NO: 564134 - DNA, 494 bp, Homo sapiens; identical to SEQ ID NO: 539894
  misc_feature: HIJSMM301BDKI4.16.53.E09.1.454.light.4.raw

SEQ ID NO: 564135 - DNA, 497 bp, Homo sapiens; identical to SEQ ID NO: 535740
  misc_feature: HIJSMM301B8YCR.3.71.G05.1.454.light.4.raw

SEQ ID NO: 564136 - DNA, 504 bp, Homo sapiens; identical to SEQ ID NO: 539083
  misc_feature: HIJSMM301DNR5V.8.19.B08.1.454.light.4.raw

SEQ ID NO: 564137 - DNA, 485 bp, Homo sapiens; identical to SEQ ID NO: 536576
  misc_feature: HIJSMM301BDMOB.46.35.D02.1.454.light.4.raw

SEQ ID NO: 564138 - DNA, 506 bp, Homo sapiens
  misc_feature: HIJSMM301BZTBT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaactagtggctgcaccatctgtcttcatcttccccg

SEQ ID NO: 564139 - DNA, 520 bp, Homo sapiens; identical to SEQ ID NO: 539176
  misc_feature: HIJSMM301C7E34.27.23.C01.1.454.light.4.raw

SEQ ID NO: 564140 - DNA, 511 bp, Homo sapiens; identical to SEQ ID NO: 535406
  misc_feature: HIJSMM301BEWUE.43.59.F04.1.454.light.4.raw

SEQ ID NO: 564141 - DNA, 499 bp, Homo sapiens; identical to SEQ ID NO: 547591
  misc_feature: HIJSMM301C5208.43.34.D01.1.454.light.4.raw

SEQ ID NO: 564142 - DNA, 463 bp, Homo sapiens; identical to SEQ ID NO: 535062
  misc_feature: HIJSMM301BRY5A.11.73.G07.1.454.light.4.raw

SEQ ID NO: 564143 - DNA, 515 bp, Homo sapiens
  misc_feature: HIJSMM301BYZ0I.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccaagggtggtgttcggcggagggaccaagctggccgtcctaggtcagcccaaggctgccccctcggtcactctgttcccaccctcctcgagtagtaca

SEQ ID NO: 564144 - DNA, 520 bp, Homo sapiens
  misc_feature: HIJSMM301AKB1J.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccacgcctcgctgcgttggtcgttttcgggcggagggaccgaacgctgacccgtccgtcgggtcacgcccaaggcctcgccccctccggtccta

SEQ ID NO: 564145 - DNA, 484 bp, Homo sapiens; identical to SEQ ID NO: 544689
  misc_feature: HIJSMM301C5T33.22.6.A06.1.454.light.4.raw

SEQ ID NO: 564146 - DNA, 467 bp, Homo sapiens
  misc_feature: HIJSMM301EJ40O.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagatttttactttcaccatcagcagcctgcagcctgaagatattgcaacatattactgtcagcagtatgataatctcccgatcaccttcggccaagggacacgactggagattaaacgaa

SEQ ID NO: 564147 - DNA, 492 bp, Homo sapiens
  misc_feature: HIJSMM301AHDUT.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtcccgtacaaggttcagtggcagtggatctgggacagatttcactctcaccgtcagcagtctgcaacctgaagtattttgctaacttactactgtcaacagagttacacgtaccccctctacttcggcggagggaccaaggcggagatcagacgaactgtgctgcaccatctgtcttcta

SEQ ID NO: 564148 - DNA, 467 bp, Homo sapiens
  misc_feature: HIJSMM301D412P.49.37.D04.1.454.light.4.raw
agtcgagagacacgaccggtgctcgatttagtagcatactgttgggtttggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccagggaccaggctggatatcagacgaa

SEQ ID NO: 564149 - DNA, 496 bp, Homo sapiens; identical to SEQ ID NO: 538466
  misc_feature: HIJSMM301CJ02H.10.33.C11.1.454.light.4.raw

SEQ ID NO: 564150 - DNA, 508 bp, Homo sapiens
  misc_feature: HIJSMM301B49MD.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagttttattactgtcaacaatattattctactccgccgacgttcggccggggacgaacgtggaaatcaaacgaactgtggctgcaccatctgtcttcta

SEQ ID NO: 564151 - DNA, 495 bp, Homo sapiens; identical to SEQ ID NO: 535293
  misc_feature: HIJSMM301BH8D5.9.1.A01.1.454.light.4.raw

SEQ ID NO: 564152 - DNA, 513 bp, Homo sapiens; identical to SEQ ID NO: 535244
  misc_feature: HIJSMM301BQBN0.17.33.C11.1.454.light.4.raw

SEQ ID NO: 564153 - DNA, 494 bp, Homo sapiens; identical to SEQ ID NO: 534994
  misc_feature: HIJSMM301B0N6G.27.78.H01.1.454.light.4.raw

SEQ ID NO: 564154 - DNA, 497 bp, Homo sapiens
  misc_feature: HIJSMM301CBFBZ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagcctccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 564155 - DNA, 461 bp, Homo sapiens
  misc_feature: HIJSMM301DVNTR.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 564156 - DNA, 498 bp, Homo sapiens
  misc_feature: HIJSMM301ADKOM.4.37.D04.1.454.light.4.raw
agcactgtagcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaa

SEQ ID NO: 564157 - DNA, 503 bp, Homo sapiens
  misc_feature: HIJSMM301D47NS.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtctaggtcagcccaaggccacccactgt

SEQ ID NO: 564158 - DNA, 506 bp, Homo sapiens
  misc_feature: HIJSMM301BLAQK.8.39.D06.1.454.light.4.raw
ctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggccaggacaaggtggcatcaacgaactgtggctgcaccatctgtcttcatcttcccgcc

SEQ ID NO: 564159 - DNA, 513 bp, Homo sapiens
  misc_feature: HIJSMM301D6PPZ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacgggatccccgatcgcttcatggctccagttctggggctgaccgctacctcaccatctccaacctccagtctgacgatgaggctgagtatcactgtggagagagccacacaattgatggccaagacggttgggtgttcggcggagggaccaaggctgaccgtcctaggtcagcccaaggctcgccccctggtcactctgttccccaccctcctcgctacgt

SEQ ID NO: 564160 - DNA, 447 bp, Homo sapiens; identical to SEQ ID NO: 535020
  misc_feature: HIJSMM301B13D2.18.9.A09.1.454.light.4.raw

SEQ ID NO: 564161 - DNA, 491 bp, Homo sapiens; identical to SEQ ID NO: 535176
  misc_feature: HIJSMM301BRXUA.13.39.D06.1.454.light.4.raw

SEQ ID NO: 564162 - DNA, 518 bp, Homo sapiens; identical to SEQ ID NO: 544387
  misc_feature: HIJSMM301BMPO5.19.80.H03.1.454.light.4.raw

SEQ ID NO: 564163 - DNA, 499 bp, Homo sapiens
  misc_feature: HIJSMM301DLOQQ.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttggccaagggaccaaggtaggaatacaaacgaactagtggctgcacc

SEQ ID NO: 564164 - DNA, 501 bp, Homo sapiens
  misc_feature: HIJSMM301BUXPR.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccccg

SEQ ID NO: 564165 - DNA, 492 bp, Homo sapiens
  misc_feature: HIJSMM301BLL9J.49.45.E01.1.454.light.4.raw
agtcgagagacacgaccggtgctcgatttagtgagtcagtaagggaaagggcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccgccctcctctcttcgact

SEQ ID NO: 564166 - DNA, 504 bp, Homo sapiens; identical to SEQ ID NO: 538521
  misc_feature: HIJSMM301A2E9C.9.12.B01.1.454.light.4.raw

SEQ ID NO: 564167 - DNA, 497 bp, Homo sapiens; identical to SEQ ID NO: 535286
  misc_feature: HIJSMM301CE1CS.18.59.F04.1.454.light.4.raw

SEQ ID NO: 564168 - DNA, 488 bp, Homo sapiens
  misc_feature: HIJSMM301DJ86F.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacacttatactaattcggcggtaggaccaagctgaccgtctgcgtcagccctaaggctcgcccctcggtcactctcgttcccgcctcctcgtctacgtaga

SEQ ID NO: 564169 - DNA, 498 bp, Homo sapiens
  misc_feature: HIJSMM301BW8RH.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctcgccccctcggtcactctcg

SEQ ID NO: 564170 - DNA, 497 bp, Homo sapiens; identical to SEQ ID NO: 539058
  misc_feature: HIJSMM301AJGBE.12.87.H10.1.454.light.4.raw

SEQ ID NO: 564171 - DNA, 463 bp, Homo sapiens
  misc_feature: HIJSMM301D79DF.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaagccaacccactgtcactctgttcccaccctcctccatactcgta

SEQ ID NO: 564172 - DNA, 494 bp, Homo sapiens; identical to SEQ ID NO: 535828
  misc_feature: HIJSMM301D8KR2.3.36.D03.1.454.light.4.raw

SEQ ID NO: 564173 - DNA, 517 bp, Homo sapiens; identical to SEQ ID NO: 546093
  misc_feature: HIJSMM301DQAWA.14.19.B08.1.454.light.4.raw

SEQ ID NO: 564174 - DNA, 472 bp, Homo sapiens; identical to SEQ ID NO: 536302
  misc_feature: HIJSMM301ANLEB.18.76.G10.1.454.light.4.raw

SEQ ID NO: 564175 - DNA, 513 bp, Homo sapiens; identical to SEQ ID NO: 539258
  misc_feature: HIJSMM301BOU9C.43.19.B08.1.454.light.4.raw

SEQ ID NO: 564176 - DNA, 507 bp, Homo sapiens; identical to SEQ ID NO: 535641
  misc_feature: HIJSMM301A58CT.10.88.H11.1.454.light.4.raw

SEQ ID NO: 564177 - DNA, 508 bp, Homo sapiens
  misc_feature: HIJSMM301CIWNX.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggaccaggctgaccgtcctaagtcagcccaaggctgccccctc

SEQ ID NO: 564178 - DNA, 487 bp, Homo sapiens
  misc_feature: HIJSMM301A1W52.4.71.G05.1.454.light.4.raw
agcactgtagcacgaccggtgctcgatttagtgtcgtcgcaagagagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacgaaa

SEQ ID NO: 564179 - DNA, 495 bp, Homo sapiens; identical to SEQ ID NO: 538269
  misc_feature: HIJSMM301BPY3R.9.1.A01.1.454.light.4.raw

SEQ ID NO: 564180 - DNA, 513 bp, Homo sapiens
  misc_feature: HIJSMM301B94DF.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatggatgacagcctgagtggtccttgggtgttcggcggagggaccaagctgaccgtcctaagtcagcccaaggctgccccctcggtcactctgttcccacctcctcg

SEQ ID NO: 564181 - DNA, 486 bp, Homo sapiens; identical to SEQ ID NO: 535043
  misc_feature: HIJSMM301BJK5A.46.35.D02.1.454.light.4.raw

SEQ ID NO: 564182 - DNA, 519 bp, Homo sapiens; identical to SEQ ID NO: 541911
  misc_feature: HIJSMM301CFDLZ.27.23.C01.1.454.light.4.raw

SEQ ID NO: 564183 - DNA, 482 bp, Homo sapiens; identical to SEQ ID NO: 536979
  misc_feature: HIJSMM301DV052.16.81.H04.1.454.light.4.raw

SEQ ID NO: 564184 - DNA, 487 bp, Homo sapiens; identical to SEQ ID NO: 543396
  misc_feature: HIJSMM301DCW7O.46.26.C04.1.454.light.4.raw

SEQ ID NO: 564185 - DNA, 512 bp, Homo sapiens; identical to SEQ ID NO: 552719
  misc_feature: HIJSMM301DTDBT.22.36.D03.1.454.light.4.raw

SEQ ID NO: 564186 - DNA, 511 bp, Homo sapiens
  misc_feature: HIJSMM301AQ9DW.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtaggaaagtacaagcgaactagtggcgtgcaccatctcgtcttcatcttcccgt

SEQ ID NO: 564187 - DNA, 479 bp, Homo sapiens; identical to SEQ ID NO: 536050
  misc_feature: HIJSMM301A0IWH.5.73.G07.1.454.light.4.raw

SEQ ID NO: 564188 - DNA, 493 bp, Homo sapiens
  misc_feature: HIJSMM301BZAYZ.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactagtggctgcaccatctgtt

SEQ ID NO: 564189 - DNA, 489 bp, Homo sapiens; identical to SEQ ID NO: 542296
  misc_feature: HIJSMM301D4JA3.17.21.B10.1.454.light.4.raw

SEQ ID NO: 564190 - DNA, 510 bp, Homo sapiens; identical to SEQ ID NO: 538614
  misc_feature: HIJSMM301BLL5U.19.59.F04.1.454.light.4.raw

SEQ ID NO: 564191 - DNA, 488 bp, Homo sapiens; identical to SEQ ID NO: 537260
  misc_feature: HIJSMM301A2QIS.47.70.G04.1.454.light.4.raw

SEQ ID NO: 564192 - DNA, 483 bp, Homo sapiens
  misc_feature: HIJSMM301B3HDI.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccgaagctgaccgtcctaggtcagcccaaggctgccccctcggtccactctgttcccgccctcctccgtgtcctgat

SEQ ID NO: 564193 - DNA, 494 bp, Homo sapiens; identical to SEQ ID NO: 534992
  misc_feature: HIJSMM301CIRCE.9.1.A01.1.454.light.4.raw

SEQ ID NO: 564194 - DNA, 501 bp, Homo sapiens; identical to SEQ ID NO: 536818
  misc_feature: HIJSMM301BBUTQ.12.82.H05.1.454.light.4.raw

SEQ ID NO: 564195 - DNA, 503 bp, Homo sapiens
  misc_feature: HIJSMM301DWE8O.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgggaggctgactattactgcagctcatttgcaggcagccgtatactcttcggcggagggaccaagctgaccgtcctaggtcagcccaaggctgccccctc

SEQ ID NO: 564196 - DNA, 482 bp, Homo sapiens
  misc_feature: HIJSMM301DDTGP.48.5.A05.1.454.light.4.raw
agtatacatacacgaccggtgctcgatttagatagatagacagggcacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggacctaa

SEQ ID NO: 564197 - DNA, 520 bp, Homo sapiens
  misc_feature: HIJSMM301EKOGG.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaagtgtgcactggtaccagcagaagccaggccaggcccctgtgctggtcgtctttgatgataccgaccggccctcagggatccctgagcgattctctggctccaactctgtgaacacggccaccctgaccatcagtcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 564198 - DNA, 509 bp, Homo sapiens; identical to SEQ ID NO: 547302
  misc_feature: HIJSMM301CDJP3.4.57.F02.1.454.light.4.raw

SEQ ID NO: 564199 - DNA, 499 bp, Homo sapiens
  misc_feature: HIJSMM301B5REH.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtctaggtcagcccaaggctgccccctcggtcactc

SEQ ID NO: 564200 - DNA, 512 bp, Homo sapiens
  misc_feature: HIJSMM301AZ8YV.14.7.A07.1.454.light.4.raw
  modified_base (260)..(260): a, c, t, g, unknown or other
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccnccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 564201 - DNA, 479 bp, Homo sapiens
  misc_feature: HIJSMM301A6VCG.16.86.H09.1.454.light.4.raw
  modified_base (461)..(461): a, c, t, g, unknown or other
tgtactactccacgaccggtgctcgatttagtgctatagacttgggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccnccctcctcgagtagtaca

SEQ ID NO: 564202 - DNA, 508 bp, Homo sapiens
  misc_feature: HIJSMM301CH0VK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagtagcctgcaggctgaagatgtggcagtttattactgtcaacagttttctcgggcgttcggtccaagggaccaacggtggaaatacaaacgaactagtggctgtcgaccatctgtcttcatcttcccgt

SEQ ID NO: 564203 - DNA, 486 bp, Homo sapiens; identical to SEQ ID NO: 535043
  misc_feature: HIJSMM301ELHCK.46.35.D02.1.454.light.4.raw

SEQ ID NO: 564204 - DNA, 354 bp, Homo sapiens; identical to SEQ ID NO: 535026
  misc_feature: HIJSMM301A1W7R.19.22.B11.1.454.light.4.raw

SEQ ID NO: 564205 - DNA, 480 bp, Homo sapiens; identical to SEQ ID NO: 547229
  misc_feature: HIJSMM301DO15U.12.10.A10.1.454.light.4.raw

SEQ ID NO: 564206 - DNA, 453 bp, Homo sapiens
  misc_feature: HIJSMM301C910T.19.86.H09.1.454.light.4.raw
tactctcgtgcacgaccggtgctcgatttagtgctatagacttgggtttgggggccgttcctgggcccagtctgtgctgactcaggccaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagaggctccagtctgaagatgaggctgattattactgtgcaatctgggatgacagtgtgaacggtccggttttcggcggagggaccaagctgaccgtcctaagtcagcccaaggctgccccctggtcactctgttcccaccctcctccacgagagta

SEQ ID NO: 564207 - DNA, 504 bp, Homo sapiens
  misc_feature: HIJSMM301CYAPW.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctc

SEQ ID NO: 564208 - DNA, 507 bp, Homo sapiens
  misc_feature: HIJSMM301DIZOW.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgtccccccg

SEQ ID NO: 564209 - DNA, 482 bp, Homo sapiens; identical to SEQ ID NO: 538815
  misc_feature: HIJSMM301CKU8M.4.34.D01.1.454.light.4.raw

SEQ ID NO: 564210 - DNA, 490 bp, Homo sapiens
  misc_feature: HIJSMM301DTPNS.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggtagggaccaaggtggagatcaaacgaactgtggctgcaccat

SEQ ID NO: 564211 - DNA, 495 bp, Homo sapiens
  misc_feature: HIJSMM301AJ62P.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccagggaccaaggtggagatcaaacgaactagtggctgcaccatctgtcttcatcttcccgt

SEQ ID NO: 564212 - DNA, 501 bp, Homo sapiens; identical to SEQ ID NO: 535746
  misc_feature: HIJSMM301D37AF.18.11.A11.1.454.light.4.raw

SEQ ID NO: 564213 - DNA, 508 bp, Homo sapiens; identical to SEQ ID NO: 535649
  misc_feature: HIJSMM301BJ4V7.47.55.E11.1.454.light.4.raw

SEQ ID NO: 564214 - DNA, 521 bp, Homo sapiens
  misc_feature: HIJSMM301CN3OT.27.23.C01.1.454.light.4.raw
  modified_base (448)..(448): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtnttcggcggagggaccaggctgaccgtcctaggtcagcccaaggctgccccctcggtcactctgttcccaccct

SEQ ID NO: 564215 - DNA, 495 bp, Homo sapiens
  misc_feature: HIJSMM301BP5RP.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggctagtttattactgtcaacaatattataataatcctatttaatttcggcggagggaccaaggtggagatcaaacgaactgtggctgcaccatctgtcttcatcttccccgccta

SEQ ID NO: 564216 - DNA, 485 bp, Homo sapiens; identical to SEQ ID NO: 538053
  misc_feature: HIJSMM301DOSSX.13.5.A05.1.454.light.4.raw

SEQ ID NO: 564217 - DNA, 479 bp, Homo sapiens; identical to SEQ ID NO: 537163
  misc_feature: HIJSMM301AQFX6.13.73.G07.1.454.light.4.raw

SEQ ID NO: 564218 - DNA, 480 bp, Homo sapiens; identical to SEQ ID NO: 557442
  misc_feature: HIJSMM301CBEVQ.8.53.E09.1.454.light.4.raw

SEQ ID NO: 564219 - DNA, 456 bp, Homo sapiens
  misc_feature: HIJSMM301DRU7B.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcaccctccaacagtcggggcgggttatgatgtacactggtaccagcagcttccgagggacacgacccccaaactcctcattctttggtagcaacaatccggccctcgacggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 564220 - DNA, 454 bp, Homo sapiens; identical to SEQ ID NO: 534964
  misc_feature: HIJSMM301A2IO4.19.86.H09.1.454.light.4.raw

SEQ ID NO: 564221 - DNA, 461 bp, Homo sapiens; identical to SEQ ID NO: 541822
  misc_feature: HIJSMM301CYWCO.22.28.C06.1.454.light.4.raw

SEQ ID NO: 564222 - DNA, 492 bp, Homo sapiens
  misc_feature: HIJSMM301DEDOQ.5.35.D02.1.454.light.4.raw
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccaggaccacagtggatatcaggcgaactgtggctgcaccatctgtcttcta

SEQ ID NO: 564223 - DNA, 489 bp, Homo sapiens; identical to SEQ ID NO: 535139
  misc_feature: HIJSMM301B0JJ6.14.55.E11.1.454.light.4.raw

SEQ ID NO: 564224 - DNA, 480 bp, Homo sapiens; identical to SEQ ID NO: 535630
  misc_feature: HIJSMM301ARWCX.40.59.F04.1.454.light.4.raw

SEQ ID NO: 564225 - DNA, 509 bp, Homo sapiens; identical to SEQ ID NO: 559299
  misc_feature: HIJSMM301BOBS5.17.28.C06.1.454.light.4.raw

SEQ ID NO: 564226 - DNA, 494 bp, Homo sapiens; identical to SEQ ID NO: 535828
  misc_feature: HIJSMM301C1S2G.3.36.D03.1.454.light.4.raw

SEQ ID NO: 564227 - DNA, 527 bp, Homo sapiens
  misc_feature: HIJSMM301A2R8Y.53.61.F06.1.454.light.4.raw
cgcgtatacacacgaccggtgctcgatttagctacgctctaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtggggatactagtagtgatcatccttgggtgttcggcggtggggaccaggctgaccgtcctaggtcagcccaaggctgccccctcggtcactctgttcccaccctcctctcgta

SEQ ID NO: 564228 - DNA, 509 bp, Homo sapiens
  misc_feature: HIJSMM301BR63O.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcacggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggcccaacccca

SEQ ID NO: 564229 - DNA, 492 bp, Homo sapiens; identical to SEQ ID NO: 539815
  misc_feature: HIJSMM301DW7GR.51.81.H04.1.454.light.4.raw

SEQ ID NO: 564230 - DNA, 484 bp, Homo sapiens; identical to SEQ ID NO: 556436
  misc_feature: HIJSMM301E0TJE.22.6.A06.1.454.light.4.raw

SEQ ID NO: 564231 - DNA, 494 bp, Homo sapiens; identical to SEQ ID NO: 534992
  misc_feature: HIJSMM301AD8O4.9.1.A01.1.454.light.4.raw

SEQ ID NO: 564232 - DNA, 487 bp, Homo sapiens; identical to SEQ ID NO: 549460
  misc_feature: HIJSMM301ANMZO.12.31.C09.1.454.light.4.raw

SEQ ID NO: 564233 - DNA, 515 bp, Homo sapiens
  misc_feature: HIJSMM301DG2JH.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctgttctcgccctctcacg

SEQ ID NO: 564234 - DNA, 507 bp, Homo sapiens
  misc_feature: HIJSMM301B59J7.4.10.A10.1.454.light.4.raw
  modified_base (459)..(459): a, c, t, g, unknown or other
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttnaccgtcctgggtcagcccaaggctgccccctcggtcactctgttccca

SEQ ID NO: 564235 - DNA, 498 bp, Homo sapiens
  misc_feature: HIJSMM301DM6IX.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtccactctgttcccaccctcctcc

SEQ ID NO: 564236 - DNA, 505 bp, Homo sapiens; identical to SEQ ID NO: 536254
  misc_feature: HIJSMM301EO683.7.71.G05.1.454.light.4.raw

SEQ ID NO: 564237 - DNA, 509 bp, Homo sapiens; identical to SEQ ID NO: 541168
  misc_feature: HIJSMM301BFQ3X.5.60.F05.1.454.light.4.raw

SEQ ID NO: 564238 - DNA, 420 bp, Homo sapiens; identical to SEQ ID NO: 541940
  misc_feature: HIJSMM301CWPBC.9.34.D01.1.454.light.4.raw

SEQ ID NO: 564239 - DNA, 493 bp, Homo sapiens
  misc_feature: HIJSMM301A5UM0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggaggatcaaacgaactgtggctgcaccatcttcg

SEQ ID NO: 564240 - DNA, 487 bp, Homo sapiens; identical to SEQ ID NO: 536536
  misc_feature: HIJSMM301DAJ7G.26.45.E01.1.454.light.4.raw

SEQ ID NO: 564241 - DNA, 489 bp, Homo sapiens; identical to SEQ ID NO: 535139
  misc_feature: HIJSMM301AMI60.14.55.E11.1.454.light.4.raw

SEQ ID NO: 564242 - DNA, 451 bp, Homo sapiens
  misc_feature: HIJSMM301DOIM4.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcactctgttcccaccctcctcacgcgtatgt

SEQ ID NO: 564243 - DNA, 508 bp, Homo sapiens
  misc_feature: HIJSMM301BPCWP.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccgt

SEQ ID NO: 564244 - DNA, 492 bp, Homo sapiens
  misc_feature: HIJSMM301CAS7Z.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattatactgcagctcatatggaggcagcgacaatttggtgttcggcggagggaccaagctgaccgtcctaggtcagcccaaggctgccccctggtccactctgttcccaccctcctcaccg

SEQ ID NO: 564245 - DNA, 491 bp, Homo sapiens; identical to SEQ ID NO: 536549
  misc_feature: HIJSMM301CH43S.47.55.E11.1.454.light.4.raw

SEQ ID NO: 564246 - DNA, 490 bp, Homo sapiens
  misc_feature: HIJSMM301BUZ06.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccgaaggttgagatcaaacgaactgtggcgtgcacca

SEQ ID NO: 564247 - DNA, 514 bp, Homo sapiens; identical to SEQ ID NO: 546238
  misc_feature: HIJSMM301EA2D4.47.85.H08.1.454.light.4.raw

SEQ ID NO: 564248 - DNA, 498 bp, Homo sapiens
  misc_feature: HIJSMM301D3TNL.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtacccaagtaacttttggccgaggggaccaagcgtggagatacaaacgaactgtggcgtgccacatcttcg

SEQ ID NO: 564249 - DNA, 504 bp, Homo sapiens; identical to SEQ ID NO: 549053
  misc_feature: HIJSMM301AQH59.4.71.G05.1.454.light.4.raw

SEQ ID NO: 564250 - DNA, 510 bp, Homo sapiens
  misc_feature: HIJSMM301B49ZC.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcggggggaccgaagctgaccgtcctaggtcagcccaaggctgccccctcggtca

SEQ ID NO: 564251 - DNA, 505 bp, Homo sapiens
  misc_feature: HIJSMM301D56GE.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgtctagtttttacttgtcagcagtatagtaactggcctccgtactactttggtccgacgggaccgaagactagaaatacaaacgaactagtggctgcaccatctggggtcttcta

SEQ ID NO: 564252 - DNA, 486 bp, Homo sapiens; identical to SEQ ID NO: 535043
  misc_feature: HIJSMM301AEOYJ.46.35.D02.1.454.light.4.raw

SEQ ID NO: 564253 - DNA, 496 bp, Homo sapiens; identical to SEQ ID NO: 536326
  misc_feature: HIJSMM301CEYGA.16.12.B01.1.454.light.4.raw

SEQ ID NO: 564254 - DNA, 511 bp, Homo sapiens
  misc_feature: HIJSMM301CZXDY.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcggtccaacggaccgaacggtaggaagtacaagacgaactagtggcgtgcgaccatctgtcttctatcttcccgt

SEQ ID NO: 564255 - DNA, 447 bp, Homo sapiens; identical to SEQ ID NO: 535201
  misc_feature: HIJSMM301A4FI8.18.9.A09.1.454.light.4.raw

SEQ ID NO: 564256 - DNA, 501 bp, Homo sapiens; identical to SEQ ID NO: 536867
  misc_feature: HIJSMM301EBIUB.5.86.H09.1.454.light.4.raw

SEQ ID NO: 564257 - DNA, 502 bp, Homo sapiens; identical to SEQ ID NO: 541971
  misc_feature: HIJSMM301BW0QG.4.39.D06.1.454.light.4.raw

SEQ ID NO: 564258 - DNA, 494 bp, Homo sapiens; identical to SEQ ID NO: 535828
  misc_feature: HIJSMM301ECANN.3.36.D03.1.454.light.4.raw

SEQ ID NO: 564259 - DNA, 507 bp, Homo sapiens
  misc_feature: HIJSMM301DARIE.15.59.F04.1.454.light.4.raw
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 564260 - DNA, 493 bp, Homo sapiens; identical to SEQ ID NO: 537281
  misc_feature: HIJSMM301C0QV1.9.1.A01.1.454.light.4.raw

SEQ ID NO: 564261 - DNA, 478 bp, Homo sapiens
  misc_feature: HIJSMM301COAH3.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatcgtgcatccactttgcatagtggggtcccatcaaggttcagcggcagtggatctgggacagaattcactctcacaatcaccagcctgcagcctgaagattttgcaacttattactgtcaacaggtttatatttacctcgtattttcggccctgggaccacagtagatatcaaacgaactgtggctgcacc

SEQ ID NO: 564262 - DNA, 499 bp, Homo sapiens
  misc_feature: HIJSMM301D7I21.10.33.C11.1.454.light.4.raw
  modified_base (361)..(361): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagatttttacnctcggcatccgcagcctgcagcctgaagattttgcgacatattactgtcaacagtatgaaaatgtcccgctcactttcggcgggggaccgaaacggtggagttcaaacgaaactgtggctgcaccatctgtcttcatt

SEQ ID NO: 564263 - DNA, 493 bp, Homo sapiens; identical to SEQ ID NO: 535745
  misc_feature: HIJSMM301AD87K.47.78.H01.1.454.light.4.raw

SEQ ID NO: 564264 - DNA, 484 bp, Homo sapiens; identical to SEQ ID NO: 535400
  misc_feature: HIJSMM301DMEKV.46.26.C04.1.454.light.4.raw

SEQ ID NO: 564265 - DNA, 465 bp, Homo sapiens
  misc_feature: HIJSMM301CE18A.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgaggtggagatcagaacgaactgtggctgcaccatctgtcttcatcttcccgccatctgaagtatagtct

SEQ ID NO: 564266 - DNA, 496 bp, Homo sapiens; identical to SEQ ID NO: 537925
  misc_feature: HIJSMM301EATN7.22.14.B03.1.454.light.4.raw

SEQ ID NO: 564267 - DNA, 507 bp, Homo sapiens
  misc_feature: HIJSMM301BNZS1.48.34.D01.1.454.light.4.raw
agtatacatacacgaccggtgctcgatttagatcgtctgtgttgggtttgggggggtcgacaagaggcagcgctctcgggacgtctccaccatggcctgggctctgctgctgttcatcctcctcactcaggacacagggtccgtgggcccagtctgccctcgactcagcctgcctccatgtctgggtctcctagacagtcgatcaccgtctcctgcactggaaccagcagtgatgttgggcgttatgaccttgtctcctggtaccaacaacacccaggcaaacgacccccaaactcttgatttatgagatcactaagcggccctcaggcgtttctaatcgcttctctggctccaagtctggcaacacggcctccctgacaatctctgggctccaggctgaggacgaggctgattattattgctgctcatatgcagggtggtactacttgggtgttcggcagaggaccaagctgaccgtcctagggtcagcccaaggctcgccccccg

SEQ ID NO: 564268 - DNA, 487 bp, Homo sapiens
  misc_feature: HIJSMM301AZ5I6.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatcacttttggccaagggaccaagctggagatcaaacgaactgtgctgcacca

SEQ ID NO: 564269 - DNA, 501 bp, Homo sapiens; identical to SEQ ID NO: 535509
  misc_feature: HIJSMM301BLI0L.15.56.F01.1.454.light.4.raw

SEQ ID NO: 564270 - DNA, 482 bp, Homo sapiens
  misc_feature: HIJSMM301EJOQK.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccaaggtggagatacaaacgaactgtgctgcaccta

SEQ ID NO: 564271 - DNA, 507 bp, Homo sapiens
  misc_feature: HIJSMM301A09Y6.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatcttcccgcat

SEQ ID NO: 564272 - DNA, 489 bp, Homo sapiens; identical to SEQ ID NO: 535139
  misc_feature: HIJSMM301AD560.14.55.E11.1.454.light.4.raw

SEQ ID NO: 564273 - DNA, 512 bp, Homo sapiens
  misc_feature: HIJSMM301AUV2Z.19.59.F04.1.454.light.4.raw
tactctcgtgcacgaccggtgctcgatttagtacacacacttagggagttgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccta

SEQ ID NO: 564274 - DNA, 499 bp, Homo sapiens
  misc_feature: HIJSMM301DTOMD.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagatttgcagtttattactgtcagcagcgtagcaactggcctccgatcaccttcggccaagggacacgactggagattaaacgaactgtggctgcaccatctgtcttcatt

SEQ ID NO: 564275 - DNA, 520 bp, Homo sapiens; identical to SEQ ID NO: 541666
  misc_feature: HIJSMM301AVD0D.41.19.B08.1.454.light.4.raw

SEQ ID NO: 564276 - DNA, 485 bp, Homo sapiens; identical to SEQ ID NO: 536040
  misc_feature: HIJSMM301B7ORJ.15.1.A01.1.454.light.4.raw

SEQ ID NO: 564277 - DNA, 492 bp, Homo sapiens
  misc_feature: HIJSMM301AJJBW.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcaggcgggtcagggacagatttcacactagaaaatcagccgggtgggggctgaggatgttggctatttattactgcatgcaggctatacaccttctgcctacttttggccaggggaccaagctggagatcaggcgtaacg

SEQ ID NO: 564278 - DNA, 504 bp, Homo sapiens; identical to SEQ ID NO: 540538
  misc_feature: HIJSMM301EJL28.7.71.G05.1.454.light.4.raw

SEQ ID NO: 564279 - DNA, 516 bp, Homo sapiens; identical to SEQ ID NO: 549597
  misc_feature: HIJSMM301AR03D.48.14.B03.1.454.light.4.raw

SEQ ID NO: 564280 - DNA, 490 bp, Homo sapiens
  misc_feature: HIJSMM301AUEK1.52.83.H06.1.454.light.4.raw
  modified_base (483)..(483): a, c, t, g, unknown or other
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcgtcggagggaccgaaggtcgagatcaaacgaactagtggctgcaccaanctgtctt

SEQ ID NO: 564281 - DNA, 509 bp, Homo sapiens; identical to SEQ ID NO: 537131
  misc_feature: HIJSMM301BP8PC.17.33.C11.1.454.light.4.raw

SEQ ID NO: 564282 - DNA, 453 bp, Homo sapiens
  misc_feature: HIJSMM301D73GI.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 564283 - DNA, 493 bp, Homo sapiens; identical to SEQ ID NO: 536246
  misc_feature: HIJSMM301DALNL.49.66.F11.1.454.light.4.raw

SEQ ID NO: 564284 - DNA, 513 bp, Homo sapiens
  misc_feature: HIJSMM301B2JXJ.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccaccctcctctctctcg

SEQ ID NO: 564285 - DNA, 488 bp, Homo sapiens; identical to SEQ ID NO: 536861
  misc_feature: HIJSMM301E17HN.12.88.H11.1.454.light.4.raw

SEQ ID NO: 564286 - DNA, 383 bp, Homo sapiens; identical to SEQ ID NO: 543660
  misc_feature: HIJSMM301B9ENR.41.37.D04.1.454.light.4.raw

SEQ ID NO: 564287 - DNA, 350 bp, Homo sapiens; identical to SEQ ID NO: 537421
  misc_feature: HIJSMM301ANLY6.13.11.A11.1.454.light.4.raw

SEQ ID NO: 564288 - DNA, 498 bp, Homo sapiens
  misc_feature: HIJSMM301AKS02.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtaggaatacaaacgaactagtggctgcaccatctgtctt

SEQ ID NO: 564289 - DNA, 491 bp, Homo sapiens; identical to SEQ ID NO: 536211
  misc_feature: HIJSMM301COKRO.16.53.E09.1.454.light.4.raw

SEQ ID NO: 564290 - DNA, 486 bp, Homo sapiens; identical to SEQ ID NO: 535385
  misc_feature: HIJSMM301DRZOL.19.71.G05.1.454.light.4.raw

SEQ ID NO: 564291 - DNA, 493 bp, Homo sapiens; identical to SEQ ID NO: 535047
  misc_feature: HIJSMM301AK4V5.16.53.E09.1.454.light.4.raw

SEQ ID NO: 564292 - DNA, 495 bp, Homo sapiens
  misc_feature: HIJSMM301DW468.18.59.F04.1.454.light.4.raw
tacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcacgtctaggtcagcccaagg

SEQ ID NO: 564293 - DNA, 515 bp, Homo sapiens
  misc_feature: HIJSMM301EWO7X.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcaggggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttccccg

SEQ ID NO: 564294 - DNA, 510 bp, Homo sapiens; identical to SEQ ID NO: 535855
  misc_feature: HIJSMM301AKNO7.17.33.C11.1.454.light.4.raw

SEQ ID NO: 564295 - DNA, 497 bp, Homo sapiens
  misc_feature: HIJSMM301BMAER.52.29.C07.1.454.light.4.raw
cgcagtacgacacgaccggtgctcgatttagagtgctacgaagggaaagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcta

SEQ ID NO: 564296 - DNA, 520 bp, Homo sapiens
  misc_feature: HIJSMM301DSDF9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccaggtcagcccaaggctgccccctcggtcactctgttcccaccct

SEQ ID NO: 564297 - DNA, 512 bp, Homo sapiens
  misc_feature: HIJSMM301ET3CM.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaaggtggaggtacaaacgaaactgtggctgcaccatctgtctt

SEQ ID NO: 564298 - DNA, 506 bp, Homo sapiens; identical to SEQ ID NO: 534969
  misc_feature: HIJSMM301A2A57.18.37.D04.1.454.light.4.raw

SEQ ID NO: 564299 - DNA, 492 bp, Homo sapiens
  misc_feature: HIJSMM301DC222.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcaccttcggccaagggacacgactggagattaaacgaactgtggctgcaccatctgtctt

SEQ ID NO: 564300 - DNA, 493 bp, Homo sapiens
  misc_feature: HIJSMM301C2AJF.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccagacccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtctt

SEQ ID NO: 564301 - DNA, 480 bp, Homo sapiens; identical to SEQ ID NO: 547848
  misc_feature: HIJSMM301BKIL0.7.83.H06.1.454.light.4.raw

SEQ ID NO: 564302 - DNA, 508 bp, Homo sapiens
  misc_feature: HIJSMM301EP6BY.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgtaccatctgtctt

SEQ ID NO: 564303 - DNA, 499 bp, Homo sapiens; identical to SEQ ID NO: 550763
  misc_feature: HIJSMM301AI67F.19.78.H01.1.454.light.4.raw

SEQ ID NO: 564304 - DNA, 497 bp, Homo sapiens
  misc_feature: HIJSMM301D4TBJ.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgaccaaggtcaccgtcctgggtcacgcccaaggcccaacccactgtca

SEQ ID NO: 564305 - DNA, 484 bp, Homo sapiens; identical to SEQ ID NO: 538247
  misc_feature: HIJSMM301BPJX7.14.53.E09.1.454.light.4.raw

SEQ ID NO: 564306 - DNA, 479 bp, Homo sapiens
  misc_feature: HIJSMM301DO2FO.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcgagggaccaagctgaccgtctcggtcagcccaaggctccg

SEQ ID NO: 564307 - DNA, 492 bp, Homo sapiens
  misc_feature: HIJSMM301CD8MH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggatttgcagtgtattactgtcagcagtatcataggtcaaacaccttcggccaagggacacgactggagattaaggaactgtggctgcaccatctgtcttcatcttccccg

SEQ ID NO: 564308 - DNA, 489 bp, Homo sapiens; identical to SEQ ID NO: 549527
  misc_feature: HIJSMM301AM8GW.15.49.E05.1.454.light.4.raw

SEQ ID NO: 564309 - DNA, 495 bp, Homo sapiens
  misc_feature: HIJSMM301AMCLP.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagtattttgctagtttattactgtcagcagtataatgacttgggtttattcactttcgccgtgggaccaagtggtatttcagacgactagtggctgcacctatctgtcttaatt

SEQ ID NO: 564310 - DNA, 501 bp, Homo sapiens; identical to SEQ ID NO: 535873
  misc_feature: HIJSMM301AS25W.17.27.C05.1.454.light.4.raw

SEQ ID NO: 564311 - DNA, 488 bp, Homo sapiens
  misc_feature: HIJSMM301CAG9R.52.25.C03.1.454.light.4.raw
cgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtt

SEQ ID NO: 564312 - DNA, 506 bp, Homo sapiens; identical to SEQ ID NO: 534969
  misc_feature: HIJSMM301C015T.18.37.D04.1.454.light.4.raw

SEQ ID NO: 564313 - DNA, 516 bp, Homo sapiens
  misc_feature: HIJSMM301DG7S0.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaagtacaagacgaacctagtcggcgtgcgaccactctgttcttctactcttcccgt

SEQ ID NO: 564314 - DNA, 509 bp, Homo sapiens; identical to SEQ ID NO: 539359
  misc_feature: HIJSMM301D292N.47.85.H08.1.454.light.4.raw

SEQ ID NO: 564315 - DNA, 506 bp, Homo sapiens
  misc_feature: HIJSMM301CWX8X.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcact

SEQ ID NO: 564316 - DNA, 486 bp, Homo sapiens
  misc_feature: HIJSMM301A9QN7.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtctaggtcacg

SEQ ID NO: 564317 - DNA, 498 bp, Homo sapiens
  misc_feature: HIJSMM301CW9ER.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtactacttttggccaggggaccaagctggagatcaaacgaactgtggctgca

SEQ ID NO: 564318 - DNA, 524 bp, Homo sapiens
  misc_feature: HIJSMM301DGZ1B.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactgtcactctcgttcccgccctcctccgtcg

SEQ ID NO: 564319 - DNA, 506 bp, Homo sapiens; identical to SEQ ID NO: 542696
  misc_feature: HIJSMM301BF3IH.7.71.G05.1.454.light.4.raw

SEQ ID NO: 564320 - DNA, 444 bp, Homo sapiens; identical to SEQ ID NO: 550016
  misc_feature: HIJSMM301DBR8A.14.76.G10.1.454.light.4.raw

SEQ ID NO: 564321 - DNA, 495 bp, Homo sapiens
  misc_feature: HIJSMM301EF3TI.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggagtatcaaacgaactgtggctgcaccatctgtcttcat

SEQ ID NO: 564322 - DNA, 501 bp, Homo sapiens
  misc_feature: HIJSMM301BZXBJ.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactagtggctgcaccatctgtcttcatcttccccg

SEQ ID NO: 564323 - DNA, 496 bp, Homo sapiens
  misc_feature: HIJSMM301AR267.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgtgccaaggaccgaacgtggaaatacaaacgaaactagtggctgcaccatctgtcttccatt

SEQ ID NO: 564324 - DNA, 488 bp, Homo sapiens
  misc_feature: HIJSMM301CWXTD.8.4.A04.1.454.light.4.raw
ctcgcgtgtccacgaccggtgctcgatttagagtagtgatcagggggaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaagctgccctcaccatcacgggggcccaggcagatgatgaatctcattattactgtgcactgcatttgcgtgatgtcaattatgtgttcggcggaggaacc

SEQ ID NO: 564325 - DNA, 514 bp, Homo sapiens; identical to SEQ ID NO: 547648
  misc_feature: HIJSMM301C3WIC.16.1.A01.1.454.light.4.raw

SEQ ID NO: 564326 - DNA, 491 bp, Homo sapiens
  misc_feature: HIJSMM301CM1VW.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttcccctcactttcggcggagggaccaaggtaggagatcaagacgaactgtggctgcacatctgtctt

SEQ ID NO: 564327 - DNA, 484 bp, Homo sapiens
  misc_feature: HIJSMM301ESEVK.40.86.H09.1.454.light.4.raw
tctagcgactcacgaccggtgctcgatttagtgctatagacttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaa

SEQ ID NO: 564328 - DNA, 497 bp, Homo sapiens; identical to SEQ ID NO: 535664
  misc_feature: HIJSMM301CHRNM.22.14.B03.1.454.light.4.raw

SEQ ID NO: 564329 - DNA, 488 bp, Homo sapiens; identical to SEQ ID NO: 553666
  misc_feature: HIJSMM301BRBO4.14.55.E11.1.454.light.4.raw
  modified_base (427)..(427): a, c, t, g, unknown or other

SEQ ID NO: 564330 - DNA, 508 bp, Homo sapiens
  misc_feature: HIJSMM301A8SD6.51.55.E11.1.454.light.4.raw
cgatcgtatacacgaccggtgctcgatttagcactcgcacgttgggtttgggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcact

SEQ ID NO: 564331 - DNA, 486 bp, Homo sapiens; identical to SEQ ID NO: 535385
  misc_feature: HIJSMM301DNQDD.19.71.G05.1.454.light.4.raw

SEQ ID NO: 564332 - DNA, 497 bp, Homo sapiens; identical to SEQ ID NO: 535286
  misc_feature: HIJSMM301AY1ZR.18.59.F04.1.454.light.4.raw

SEQ ID NO: 564333 - DNA, 447 bp, Homo sapiens; identical to SEQ ID NO: 535201
  misc_feature: HIJSMM301CZ7ST.18.9.A09.1.454.light.4.raw

SEQ ID NO: 564334 - DNA, 486 bp, Homo sapiens
  misc_feature: HIJSMM301A6FK4.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatattattctccagcgttcggccaggggaccaaggtggaagtcaagcgaactgtggctgcaccatctgt

SEQ ID NO: 564335 - DNA, 505 bp, Homo sapiens; identical to SEQ ID NO: 536254
  misc_feature: HIJSMM301D79RU.7.71.G05.1.454.light.4.raw

SEQ ID NO: 564336 - DNA, 498 bp, Homo sapiens
  misc_feature: HIJSMM301BB1F6.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcgtccgaagggaccgacgggtaggaaagtactaaacgaaactacgtggcgtgcaccaactctgtcttt

SEQ ID NO: 564337 - DNA, 447 bp, Homo sapiens; identical to SEQ ID NO: 535201
  misc_feature: HIJSMM301DINRV.18.9.A09.1.454.light.4.raw

SEQ ID NO: 564338 - DNA, 519 bp, Homo sapiens
  misc_feature: HIJSMM301A74AT.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgt

SEQ ID NO: 564339 - DNA, 476 bp, Homo sapiens
  misc_feature: HIJSMM301AEOTJ.52.1.A01.1.454.light.4.raw
  modified_base (452)..(452): a, c, t, g, unknown or other
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctggccgactagtggntatcaaacgaactgtggctgcacc

SEQ ID NO: 564340 - DNA, 495 bp, Homo sapiens; identical to SEQ ID NO: 537165
  misc_feature: HIJSMM301AZHNJ.51.14.B03.1.454.light.4.raw

SEQ ID NO: 564341 - DNA, 484 bp, Homo sapiens; identical to SEQ ID NO: 535441
  misc_feature: HIJSMM301DLYKX.26.60.F05.1.454.light.4.raw

SEQ ID NO: 564342 - DNA, 486 bp, Homo sapiens; identical to SEQ ID NO: 535458
  misc_feature: HIJSMM301C6PSY.7.75.G09.1.454.light.4.raw

SEQ ID NO: 564343 - DNA, 506 bp, Homo sapiens; identical to SEQ ID NO: 539926
  misc_feature: HIJSMM301EHE2A.5.24.C02.1.454.light.4.raw

SEQ ID NO: 564344 - DNA, 476 bp, Homo sapiens
  misc_feature: HIJSMM301C6C7H.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggagtccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtccaggtcagcccaaggccaa

SEQ ID NO: 564345 - DNA, 477 bp, Homo sapiens; identical to SEQ ID NO: 536960
  misc_feature: HIJSMM301CLN1A.52.1.A01.1.454.light.4.raw

SEQ ID NO: 564346 - DNA, 488 bp, Homo sapiens; identical to SEQ ID NO: 536861
  misc_feature: HIJSMM301AQ63M.12.88.H11.1.454.light.4.raw

SEQ ID NO: 564347 - DNA, 491 bp, Homo sapiens
  misc_feature: HIJSMM301ATIQI.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcaccatctgtcttcat

SEQ ID NO: 564348 - DNA, 495 bp, Homo sapiens; identical to SEQ ID NO: 535821
  misc_feature: HIJSMM301DVZPH.3.31.C09.1.454.light.4.raw

SEQ ID NO: 564349 - DNA, 501 bp, Homo sapiens; identical to SEQ ID NO: 536142
  misc_feature: HIJSMM301D9IWD.15.1.A01.1.454.light.4.raw

SEQ ID NO: 564350 - DNA, 494 bp, Homo sapiens; identical to SEQ ID NO: 535629
  misc_feature: HIJSMM301AHHS7.4.27.C05.1.454.light.4.raw

SEQ ID NO: 564351 - DNA, 505 bp, Homo sapiens; identical to SEQ ID NO: 535503
  misc_feature: HIJSMM301ERMEQ.8.28.C06.1.454.light.4.raw

SEQ ID NO: 564352 - DNA, 499 bp, Homo sapiens
  misc_feature: HIJSMM301ASIKA.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctccttcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttcccg

SEQ ID NO: 564353 - DNA, 502 bp, Homo sapiens; identical to SEQ ID NO: 549179
  misc_feature: HIJSMM301CM0PG.14.57.F02.1.454.light.4.raw

SEQ ID NO: 564354 - DNA, 481 bp, Homo sapiens
  misc_feature: HIJSMM301BLE0N.17.39.D06.1.454.light.4.raw
cgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttggccaagggaccaaggtggaaatcaaacgaactgtgg

SEQ ID NO: 564355 - DNA, 486 bp, Homo sapiens
  misc_feature: HIJSMM301DJGQG.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaattcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagcccc

SEQ ID NO: 564356 - DNA, 513 bp, Homo sapiens
  misc_feature: HIJSMM301AT6UK.15.34.D01.1.454.light.4.raw
tctacgtagccacgaccggtgctcgatttagatcgtctgtgttggggttgggaagccgtgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctcgccccctcggtcactctcg

SEQ ID NO: 564357 - DNA, 501 bp, Homo sapiens; identical to SEQ ID NO: 536818
  misc_feature: HIJSMM301EM3KK.12.82.H05.1.454.light.4.raw

SEQ ID NO: 564358 - DNA, 495 bp, Homo sapiens
  misc_feature: HIJSMM301EAZ0D.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccaacgggaccgaacggtggaaagtacaaacgaactagtggcgtgcgaccat

SEQ ID NO: 564359 - DNA, 495 bp, Homo sapiens
  misc_feature: HIJSMM301EPDXE.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcta

SEQ ID NO: 564360 - DNA, 493 bp, Homo sapiens
  misc_feature: HIJSMM301DHXBZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtct

SEQ ID NO: 564361 - DNA, 471 bp, Homo sapiens; identical to SEQ ID NO: 537461
  misc_feature: HIJSMM301BLVLH.7.81.H04.1.454.light.4.raw

SEQ ID NO: 564362 - DNA, 447 bp, Homo sapiens; identical to SEQ ID NO: 560488
  misc_feature: HIJSMM301BGJHR.18.73.G07.1.454.light.4.raw

SEQ ID NO: 564363 - DNA, 506 bp, Homo sapiens
  misc_feature: HIJSMM301DKHS6.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggtgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcta

SEQ ID NO: 564364 - DNA, 479 bp, Homo sapiens
  misc_feature: HIJSMM301DEK61.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggaggatcaaacgaactgtggctgcacc

SEQ ID NO: 564365 - DNA, 503 bp, Homo sapiens
  misc_feature: HIJSMM301AX3NQ.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 564366 - DNA, 454 bp, Homo sapiens; identical to SEQ ID NO: 534964
  misc_feature: HIJSMM301DC4M9.19.86.H09.1.454.light.4.raw

SEQ ID NO: 564367 - DNA, 506 bp, Homo sapiens; identical to SEQ ID NO: 539303
  misc_feature: HIJSMM301DXCQ9.8.19.B08.1.454.light.4.raw

SEQ ID NO: 564368 - DNA, 488 bp, Homo sapiens; identical to SEQ ID NO: 537527
  misc_feature: HIJSMM301CX0KU.26.78.H01.1.454.light.4.raw

SEQ ID NO: 564369 - DNA, 489 bp, Homo sapiens
  misc_feature: HIJSMM301EVYI3.19.71.G05.1.454.light.4.raw
  modified_base (478)..(478): a, c, t, g, unknown or other
tactctcgtgcacgaccggtgctcgatttagtgtcgtcgcaagagagaggggggagggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttcccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggacaacggtaggntatcagacgaa

SEQ ID NO: 564370 - DNA, 508 bp, Homo sapiens; identical to SEQ ID NO: 545298
  misc_feature: HIJSMM301A6ZRH.8.42.D09.1.454.light.4.raw

SEQ ID NO: 564371 - DNA, 515 bp, Homo sapiens
  misc_feature: HIJSMM301ETJMZ.27.78.H01.1.454.light.4.raw
  modified_base (502)..(502): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcagtggcagtggatctgggacactatttccaccctccaccatcaatagcctggaagctgaagatgctgctaactttattactgtcatcagtagtaccttactttacctacaagtgaatcctacccgttcggaccgaagggacacgacgtggaagaattaaacgaactgtggctcncaccatctgtctt

SEQ ID NO: 564372 - DNA, 497 bp, Homo sapiens
  misc_feature: HIJSMM301BTR4C.7.5.A05.1.454.light.4.raw
  modified_base (486)..(486): a, c, t, g, unknown or other
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggcngccccctcggt

SEQ ID NO: 564373 - DNA, 511 bp, Homo sapiens
  misc_feature: HIJSMM301DKPXF.5.59.F04.1.454.light.4.raw
  modified_base (479)..(479): a, c, t, g, unknown or other
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttgccaggaccgaagtaggaaagtacaaacgaactagtaggngtgcaccaactacctgtcttctactcttcccc

SEQ ID NO: 564374 - DNA, 486 bp, Homo sapiens
  misc_feature: HIJSMM301AX71A.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaac

SEQ ID NO: 564375 - DNA, 503 bp, Homo sapiens
  misc_feature: HIJSMM301DTAV0.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggggcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccat

SEQ ID NO: 564376 - DNA, 497 bp, Homo sapiens; identical to SEQ ID NO: 536371
  misc_feature: HIJSMM301B58DO.16.78.H01.1.454.light.4.raw

SEQ ID NO: 564377 - DNA, 508 bp, Homo sapiens
  misc_feature: HIJSMM301EOOIL.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcactcactgcacaggttcttgggccagctttttgctgactcagccccactctgagtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggtcgggaccaagctgaccgtcctaggtcagcccaaggctgccccctcggtcta

SEQ ID NO: 564378 - DNA, 518 bp, Homo sapiens
  misc_feature: HIJSMM301DMWV7.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcacttcggtcccgggacccgaaacgtaggaaagtacaaacgaaactagtggctgcaccatctgtcttcatcttcccgtccact

SEQ ID NO: 564379 - DNA, 499 bp, Homo sapiens
  misc_feature: HIJSMM301B59PW.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttcta

SEQ ID NO: 564380 - DNA, 494 bp, Homo sapiens
  misc_feature: HIJSMM301D76IX.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctagggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttccca

SEQ ID NO: 564381 - DNA, 494 bp, Homo sapiens; identical to SEQ ID NO: 534992
  misc_feature: HIJSMM301CLRSA.9.1.A01.1.454.light.4.raw

SEQ ID NO: 564382 - DNA, 509 bp, Homo sapiens
  misc_feature: HIJSMM301BBUJW.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctgaggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccta

SEQ ID NO: 564383 - DNA, 497 bp, Homo sapiens
  misc_feature: HIJSMM301BOMGP.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagaattaaaggaactgtggctgcaccatctgtcttcatccttccccg

SEQ ID NO: 564384 - DNA, 454 bp, Homo sapiens; identical to SEQ ID NO: 536943
  misc_feature: HIJSMM301BFEV7.19.86.H09.1.454.light.4.raw

SEQ ID NO: 564385 - DNA, 505 bp, Homo sapiens; identical to SEQ ID NO: 543540
  misc_feature: HIJSMM301A4J4S.9.12.B01.1.454.light.4.raw

SEQ ID NO: 564386 - DNA, 497 bp, Homo sapiens; identical to SEQ ID NO: 563503
  misc_feature: HIJSMM301DA51M.7.5.A05.1.454.light.4.raw

SEQ ID NO: 564387 - DNA, 484 bp, Homo sapiens; identical to SEQ ID NO: 539605
  misc_feature: HIJSMM301C4GFL.46.26.C04.1.454.light.4.raw

SEQ ID NO: 564388 - DNA, 511 bp, Homo sapiens
  misc_feature: HIJSMM301C0T1R.48.57.F02.1.454.light.4.raw
agtatacatacacgaccggtgctcgatttagctcgatatagttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaatttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttatgtgctgtttgggatgacgacatgaatggttcgattttcggcggagggaccaaactgaccgtcctggtcagcccaaggctgccccctcggtca

SEQ ID NO: 564389 - DNA, 487 bp, Homo sapiens
  misc_feature: HIJSMM301BX5LS.52.35.D02.1.454.light.4.raw
cgcagtacgacacgaccggtgctcgatttagcacacgatagttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaaatagttactccttcacttttcggccctgggaccaaagtggacatcaaacgaactgtggctgcaccatctgtt

SEQ ID NO: 564390 - DNA, 414 bp, Homo sapiens; identical to SEQ ID NO: 563153
  misc_feature: HIJSMM301D7EL9.48.39.D06.1.454.light.4.raw

SEQ ID NO: 564391 - DNA, 497 bp, Homo sapiens
  misc_feature: HIJSMM301ANDSL.13.39.D06.1.454.light.4.raw
tcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgtatattggtatcagcagctcccaggaacggcccccaaacagctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtccggtgttcggcggagggaccaagctgaccgtctaggtcagccccg

SEQ ID NO: 564392 - DNA, 505 bp, Homo sapiens
  misc_feature: HIJSMM301DLBGJ.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagttttattactgtcagcaatatttttctatcctccgtggacgttcggccaagggaccagggtggaaatcagacgaactgtggctgcaccatctgtctt

SEQ ID NO: 564393 - DNA, 499 bp, Homo sapiens; identical to SEQ ID NO: 538643
  misc_feature: HIJSMM301DNOGO.48.1.A01.1.454.light.4.raw

SEQ ID NO: 564394 - DNA, 485 bp, Homo sapiens; identical to SEQ ID NO: 535653
  misc_feature: HIJSMM301C61BX.47.62.F07.1.454.light.4.raw

SEQ ID NO: 564395 - DNA, 482 bp, Homo sapiens
  misc_feature: HIJSMM301AFEKK.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcgcggagggaccaaggtggagatcaaacgaactgtggctgca

SEQ ID NO: 564396 - DNA, 494 bp, Homo sapiens; identical to SEQ ID NO: 535828
  misc_feature: HIJSMM301AV2LE.3.36.D03.1.454.light.4.raw

SEQ ID NO: 564397 - DNA, 503 bp, Homo sapiens
  misc_feature: HIJSMM301DKF4O.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgcca

SEQ ID NO: 564398 - DNA, 487 bp, Homo sapiens
  misc_feature: HIJSMM301CRYOZ.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactggagattaaacgaactgtggctgcaccat

SEQ ID NO: 564399 - DNA, 518 bp, Homo sapiens
  misc_feature: HIJSMM301CL3ED.9.2.A02.1.454.light.4.raw
tgatacgtctcacgaccggtgctcgatttagactcatctacaggggggggtcgtcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccaccct

SEQ ID NO: 564400 - DNA, 481 bp, Homo sapiens; identical to SEQ ID NO: 560621
  misc_feature: HIJSMM301DK981.41.34.D01.1.454.light.4.raw

SEQ ID NO: 564401 - DNA, 489 bp, Homo sapiens
  misc_feature: HIJSMM301AYF1S.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccgaaggtggaggatcaaacgaactgtggctgcaccatctgt

SEQ ID NO: 564402 - DNA, 493 bp, Homo sapiens; identical to SEQ ID NO: 535745
  misc_feature: HIJSMM301DR7VN.47.78.H01.1.454.light.4.raw

SEQ ID NO: 564403 - DNA, 506 bp, Homo sapiens; identical to SEQ ID NO: 554070
  misc_feature: HIJSMM301AILMY.15.5.A05.1.454.light.4.raw

SEQ ID NO: 564404 - DNA, 515 bp, Homo sapiens
  misc_feature: HIJSMM301BXDK4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaacgggaccgaaggtaggaaagtacaaacgaaactacgtggcgtgcaccatctgtcttctactcttccccg

SEQ ID NO: 564405 - DNA, 506 bp, Homo sapiens
  misc_feature: HIJSMM301DNQXZ.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgacgatgtggctagtttattactgtcaacagttttcncgggcgttcggccaagggaccaaggtaggaatacaaacgaactagtggctgcaccatctgtcttcatcttaccccg

SEQ ID NO: 564406 - DNA, 521 bp, Homo sapiens
  misc_feature: HIJSMM301A37SD.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacaagacgaacgtacgtggcgttcgcgaccaactctgtcttctactcttcccgt

SEQ ID NO: 564407 - DNA, 499 bp, Homo sapiens; identical to SEQ ID NO: 547269
  misc_feature: HIJSMM301AP63A.14.59.F04.1.454.light.4.raw

SEQ ID NO: 564408 - DNA, 488 bp, Homo sapiens; identical to SEQ ID NO: 551155
  misc_feature: HIJSMM301ENB07.3.33.C11.1.454.light.4.raw

SEQ ID NO: 564409 - DNA, 515 bp, Homo sapiens
  misc_feature: HIJSMM301EGNZ9.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgaggagggccaccaagtcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagagatttttgttaaggggaaagtaatgaagttaa

SEQ ID NO: 564410 - DNA, 494 bp, Homo sapiens; identical to SEQ ID NO: 539894
  misc_feature: HIJSMM301CPJLZ.16.53.E09.1.454.light.4.raw

SEQ ID NO: 564411 - DNA, 494 bp, Homo sapiens; identical to SEQ ID NO: 553467
  misc_feature: HIJSMM301EMZ72.13.67.G01.1.454.light.4.raw

SEQ ID NO: 564412 - DNA, 492 bp, Homo sapiens
  misc_feature: HIJSMM301CS4X6.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccact

SEQ ID NO: 564413 - DNA, 454 bp, Homo sapiens; identical to SEQ ID NO: 534964
  misc_feature: HIJSMM301DAJ1V.19.86.H09.1.454.light.4.raw

SEQ ID NO: 564414 - DNA, 522 bp, Homo sapiens; identical to SEQ ID NO: 538091
  misc_feature: HIJSMM301ECVOT.27.23.C01.1.454.light.4.raw

SEQ ID NO: 564415 - DNA, 499 bp, Homo sapiens
  misc_feature: HIJSMM301CBKUT.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaagggaccgaaggtaggaaagtacaaacgaactacgtggctgcaccatctgtt

SEQ ID NO: 564416 - DNA, 486 bp, Homo sapiens
  misc_feature: HIJSMM301CBPR7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctt

SEQ ID NO: 564417 - DNA, 498 bp, Homo sapiens
  misc_feature: HIJSMM301EJ5O7.43.35.D02.1.454.light.4.raw
tgtgagtagtcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccgaagggaccaacgtaggaaatacaaacgaactagtggctgcaccatctgtcttcat

SEQ ID NO: 564418 - DNA, 488 bp, Homo sapiens; identical to SEQ ID NO: 537124
  misc_feature: HIJSMM301APSMO.11.25.C03.1.454.light.4.raw

SEQ ID NO: 564419 - DNA, 488 bp, Homo sapiens; identical to SEQ ID NO: 535990
  misc_feature: HIJSMM301CJ1MO.11.28.C06.1.454.light.4.raw

SEQ ID NO: 564420 - DNA, 483 bp, Homo sapiens; identical to SEQ ID NO: 535413
  misc_feature: HIJSMM301DS3V0.26.78.H01.1.454.light.4.raw

SEQ ID NO: 564421 - DNA, 517 bp, Homo sapiens; identical to SEQ ID NO: 540154
  misc_feature: HIJSMM301DK6NQ.41.55.E11.1.454.light.4.raw

SEQ ID NO: 564422 - DNA, 489 bp, Homo sapiens
  misc_feature: HIJSMM301CKQ5A.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggccctcgggaccagagtggatgtcaaacgaactagt

SEQ ID NO: 564423 - DNA, 441 bp, Homo sapiens; identical to SEQ ID NO: 534971
  misc_feature: HIJSMM301BOLW1.11.3.A03.1.454.light.4.raw

SEQ ID NO: 564424 - DNA, 512 bp, Homo sapiens
  misc_feature: HIJSMM301EO1WR.8.33.C11.1.454.light.4.raw
ctcgcgtgtccacgaccggtgctcgatttagagtgagctcgttggggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccacgttcggcccgtgggaccgaaggtggagatacaaacgaactagtggcgtggcaccactctgtcttc

SEQ ID NO: 564425 - DNA, 445 bp, Homo sapiens
  misc_feature: HIJSMM301C370W.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactttgttcccgcctcctccatactcgta

SEQ ID NO: 564426 - DNA, 492 bp, Homo sapiens
  misc_feature: HIJSMM301A5NY2.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcgatttattactgtcagcagtataataactggcctccacggtacacttttggccaggggaccaagctggagatcaaacgaactgtggctgcaccat

SEQ ID NO: 564427 - DNA, 499 bp, Homo sapiens; identical to SEQ ID NO: 543887
  misc_feature: HIJSMM301EVSG7.10.65.F10.1.454.light.4.raw

SEQ ID NO: 564428 - DNA, 513 bp, Homo sapiens
  misc_feature: HIJSMM301C6KEB.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgcctcctc

SEQ ID NO: 564429 - DNA, 502 bp, Homo sapiens
  misc_feature: HIJSMM301CZK1Z.9.53.E09.1.454.light.4.raw
tgatacgtctcacgaccggtgctcgatttagagagagtgtgttgggtttgggggggtcacaagaggcagcgctctcgggacgtcctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccc

SEQ ID NO: 564430 - DNA, 495 bp, Homo sapiens
  misc_feature: HIJSMM301DZ9U8.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgccagggaccaacggtgacgatcaaacgaactagtggcgtcgcaccaactctgtctt

SEQ ID NO: 564431 - DNA, 445 bp, Homo sapiens
  misc_feature: HIJSMM301BFLZ5.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggcccgtcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 564432 - DNA, 494 bp, Homo sapiens
  misc_feature: HIJSMM301DZ36N.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaaactgtggctgcaccatctgtcttcat

SEQ ID NO: 564433 - DNA, 503 bp, Homo sapiens
  misc_feature: HIJSMM301DGUVD.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtgaccgtcctaggtcagcccaaggctgcccccc

SEQ ID NO: 564434 - DNA, 503 bp, Homo sapiens
  misc_feature: HIJSMM301ATPDX.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccacctcctcg

SEQ ID NO: 564435 - DNA, 504 bp, Homo sapiens
  misc_feature: HIJSMM301BOZ4F.9.53.E09.1.454.light.4.raw
  modified_base (356)..(356): a, c, t, g, unknown or other
tgatacgtctcacgaccggtgctcgatttagagagagtgtgttgggtttggggggggtcgacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaacctcatcatttatgaggtcactaagcggccctcaggggtttctattcgcttctctggctccaagtntgacaacacggcctccctgacaatctctgggctccaggctgaggacgaggctgattattactgctgctcatatgcagatggtgacactcccgtggtattcgcggagggccaaggtgaccgtcctaggtcagcccaaggctgccccccg

SEQ ID NO: 564436 - DNA, 522 bp, Homo sapiens
  misc_feature: HIJSMM301BSDR9.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggacaaggtcaccgtcctaggtcagcccaaggccaacccacctgtcactctcgttcccgccctcctccgtgtc

SEQ ID NO: 564437 - DNA, 478 bp, Homo sapiens; identical to SEQ ID NO: 535129
  misc_feature: HIJSMM301BSIBS.11.11.A11.1.454.light.4.raw

SEQ ID NO: 564438 - DNA, 489 bp, Homo sapiens; identical to SEQ ID NO: 535091
  misc_feature: HIJSMM301ECWSG.47.36.D03.1.454.light.4.raw

SEQ ID NO: 564439 - DNA, 500 bp, Homo sapiens; identical to SEQ ID NO: 546095
  misc_feature: HIJSMM301A5QIQ.52.78.H01.1.454.light.4.raw

SEQ ID NO: 564440 - DNA, 494 bp, Homo sapiens
  misc_feature: HIJSMM301AJACM.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattcactttcggcccgtggaccaaagtaggatttcagacgaactgtggctgcaccatctgtcttcta

SEQ ID NO: 564441 - DNA, 503 bp, Homo sapiens; identical to SEQ ID NO: 544132
  misc_feature: HIJSMM301BWHYU.7.71.G05.1.454.light.4.raw

SEQ ID NO: 564442 - DNA, 504 bp, Homo sapiens
  misc_feature: HIJSMM301BWVQU.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagaccccg

SEQ ID NO: 564443 - DNA, 496 bp, Homo sapiens
  misc_feature: HIJSMM301C6UXF.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctcgccccctcggtcactctgttcccaccctcctcacgtcg

SEQ ID NO: 564444 - DNA, 495 bp, Homo sapiens
  misc_feature: HIJSMM301C3INX.16.10.A10.1.454.light.4.raw
  modified_base (488)..(488): a, c, t, g, unknown or other
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactcngttccca

SEQ ID NO: 564445 - DNA, 496 bp, Homo sapiens
  misc_feature: HIJSMM301CJF1L.48.53.E09.1.454.light.4.raw
agtatacatacacgaccggtgctcgatttagagagagtgtgttgggtttggggacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 564446 - DNA, 494 bp, Homo sapiens
  misc_feature: HIJSMM301EHB02.49.78.H01.1.454.light.4.raw
agtcgagagacacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtggagatcaaacgaactgtggctgcaccatctgt

SEQ ID NO: 564447 - DNA, 521 bp, Homo sapiens; identical to SEQ ID NO: 539470
  misc_feature: HIJSMM301DC0AJ.27.23.C01.1.454.light.4.raw

SEQ ID NO: 564448 - DNA, 495 bp, Homo sapiens; identical to SEQ ID NO: 559953
  misc_feature: HIJSMM301DAHRL.51.12.B01.1.454.light.4.raw

SEQ ID NO: 564449 - DNA, 564 bp, Homo sapiens
  misc_feature: HIJSMM301DP0EE.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttggggtgtttcgggcgggaggggacccaaaacgtcgtaccggtacccgttacggttacggtacgacccgaaccggaacggtcgtcccccgtcccccggttccggtacctccttcgtttcccgtaccccctccccttcccttacgttacgtacggtacgtacgtaggcgggccggtcggcggaacggacggccgactaagt

SEQ ID NO: 564450 - DNA, 501 bp, Homo sapiens; identical to SEQ ID NO: 535746
  misc_feature: HIJSMM301ASPMR.18.11.A11.1.454.light.4.raw

SEQ ID NO: 564451 - DNA, 513 bp, Homo sapiens
  misc_feature: HIJSMM301BQUKX.14.78.H01.1.454.light.4.raw
cgtctagtaccacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtctaagtcagcccaaggctgccccctcggtcactctgtt

SEQ ID NO: 564452 - DNA, 508 bp, Homo sapiens; identical to SEQ ID NO: 536062
  misc_feature: HIJSMM301BC9Y2.11.57.F02.1.454.light.4.raw

SEQ ID NO: 564453 - DNA, 513 bp, Homo sapiens
  misc_feature: HIJSMM301DX21M.15.86.H09.1.454.light.4.raw
  modified_base (400)..(400): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccaanacaaattgatggccaaagacggttggtgttcggcggaggaccaagctgaccgtcctaggtcagcccaaggctgccccctggtcactctgttcccaccctcctcgctacgtaga

SEQ ID NO: 564454 - DNA, 503 bp, Homo sapiens; identical to SEQ ID NO: 538884
  misc_feature: HIJSMM301C7EN8.27.78.H01.1.454.light.4.raw

SEQ ID NO: 564455 - DNA, 503 bp, Homo sapiens; identical to SEQ ID NO: 536834
  misc_feature: HIJSMM301AU7SJ.2.35.D02.1.454.light.4.raw

SEQ ID NO: 564456 - DNA, 487 bp, Homo sapiens; identical to SEQ ID NO: 536025
  misc_feature: HIJSMM301BV1GN.17.34.D01.1.454.light.4.raw

SEQ ID NO: 564457 - DNA, 496 bp, Homo sapiens
  misc_feature: HIJSMM301CN6CF.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaagg

SEQ ID NO: 564458 - DNA, 508 bp, Homo sapiens; identical to SEQ ID NO: 540640
  misc_feature: HIJSMM301AT628.5.60.F05.1.454.light.4.raw

SEQ ID NO: 564459 - DNA, 494 bp, Homo sapiens; identical to SEQ ID NO: 538230
  misc_feature: HIJSMM301A436C.11.71.G05.1.454.light.4.raw

SEQ ID NO: 564460 - DNA, 505 bp, Homo sapiens
  misc_feature: HIJSMM301AMTWC.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctggacgaccagcctcgctgcttggcttttcggtcggagggaccaagctgaccgtcctgggtcagcccaaggctgccccctcggtca

SEQ ID NO: 564461 - DNA, 482 bp, Homo sapiens; identical to SEQ ID NO: 535352
  misc_feature: HIJSMM301ALS1S.16.81.H04.1.454.light.4.raw

SEQ ID NO: 564462 - DNA, 502 bp, Homo sapiens; identical to SEQ ID NO: 539481
  misc_feature: HIJSMM301DL8VG.19.78.H01.1.454.light.4.raw

SEQ ID NO: 564463 - DNA, 500 bp, Homo sapiens
  misc_feature: HIJSMM301A2K8A.52.51.E07.1.454.light.4.raw
cgcagtacgacacgaccggtgctcgatttagcatactctacaacacacaaagggggagctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaaggtggaggatcaaacgaactgtggctgca

SEQ ID NO: 564464 - DNA, 483 bp, Homo sapiens
  misc_feature: HIJSMM301ELACK.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgccactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaacgaactgtggctgcaccat

SEQ ID NO: 564465 - DNA, 505 bp, Homo sapiens
  misc_feature: HIJSMM301DYU5Q.47.84.H07.1.454.light.4.raw
agctcacgtacacgaccggtgctcgatttagcagacgtctgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgacgttcg

SEQ ID NO: 564466 - DNA, 521 bp, Homo sapiens; identical to SEQ ID NO: 538715
  misc_feature: HIJSMM301A3H4K.27.23.C01.1.454.light.4.raw

SEQ ID NO: 564467 - DNA, 494 bp, Homo sapiens; identical to SEQ ID NO: 537153
  misc_feature: HIJSMM301C8G2M.11.59.F04.1.454.light.4.raw

SEQ ID NO: 564468 - DNA, 497 bp, Homo sapiens
  misc_feature: HIJSMM301AIJX9.48.60.F05.1.454.light.4.raw
agtatacatacacgaccggtgctcgatttagtacgtcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgccta

SEQ ID NO: 564469 - DNA, 506 bp, Homo sapiens
  misc_feature: HIJSMM301BLS6C.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcatttgatgtcactaagcggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaaccccactgtcactcttcg

SEQ ID NO: 564470 - DNA, 521 bp, Homo sapiens
  misc_feature: HIJSMM301AQG8K.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctcact

SEQ ID NO: 564471 - DNA, 521 bp, Homo sapiens; identical to SEQ ID NO: 538715
  misc_feature: HIJSMM301D11L0.27.23.C01.1.454.light.4.raw

SEQ ID NO: 564472 - DNA, 509 bp, Homo sapiens; identical to SEQ ID NO: 543772
  misc_feature: HIJSMM301D4F4D.2.21.B10.1.454.light.4.raw

SEQ ID NO: 564473 - DNA, 522 bp, Homo sapiens; identical to SEQ ID NO: 538091
  misc_feature: HIJSMM301D8HCL.27.23.C01.1.454.light.4.raw

SEQ ID NO: 564474 - DNA, 501 bp, Homo sapiens; identical to SEQ ID NO: 550139
  misc_feature: HIJSMM301EIQ8Y.15.56.F01.1.454.light.4.raw

SEQ ID NO: 564475 - DNA, 515 bp, Homo sapiens
  misc_feature: HIJSMM301B3X1C.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtagac

SEQ ID NO: 564476 - DNA, 494 bp, Homo sapiens; identical to SEQ ID NO: 534992
  misc_feature: HIJSMM301CF26N.9.1.A01.1.454.light.4.raw

SEQ ID NO: 564477 - DNA, 440 bp, Homo sapiens
  misc_feature: HIJSMM301DJK41.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctcctactcgta

SEQ ID NO: 564478 - DNA, 486 bp, Homo sapiens; identical to SEQ ID NO: 539294
  misc_feature: HIJSMM301DIHGI.12.33.C11.1.454.light.4.raw

SEQ ID NO: 564479 - DNA, 503 bp, Homo sapiens
  misc_feature: HIJSMM301B0F9Q.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatcttccccg

SEQ ID NO: 564480 - DNA, 447 bp, Homo sapiens; identical to SEQ ID NO: 535201
  misc_feature: HIJSMM301CAHOJ.18.9.A09.1.454.light.4.raw

SEQ ID NO: 564481 - DNA, 484 bp, Homo sapiens; identical to SEQ ID NO: 535400
  misc_feature: HIJSMM301CSTD2.46.26.C04.1.454.light.4.raw

SEQ ID NO: 564482 - DNA, 504 bp, Homo sapiens
  misc_feature: HIJSMM301BUWQ7.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaacgactgaccgtccgtccggtcgacgcccaacggcgtcgcccccgtccggtcg

SEQ ID NO: 564483 - DNA, 482 bp, Homo sapiens; identical to SEQ ID NO: 539800
  misc_feature: HIJSMM301EGVZO.21.25.C03.1.454.light.4.raw

SEQ ID NO: 564484 - DNA, 477 bp, Homo sapiens
  misc_feature: HIJSMM301D7LND.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctggcacc

SEQ ID NO: 564485 - DNA, 454 bp, Homo sapiens; identical to SEQ ID NO: 536347
  misc_feature: HIJSMM301AP1DU.19.86.H09.1.454.light.4.raw

SEQ ID NO: 564486 - DNA, 502 bp, Homo sapiens
  misc_feature: HIJSMM301AICG9.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagccaaggctgccccctcggtcactctgttcccc

SEQ ID NO: 564487 - DNA, 487 bp, Homo sapiens
  misc_feature: HIJSMM301AWT4A.49.76.G10.1.454.light.4.raw
agtcgagagacacgaccggtgctcgatttagtcactcatacaggggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggctcctgatctatgctgcatccaatttgcaaagtggggtcccatcaaggttcagtgccagtggatctgggacagacttcaccctcaccatcgacagtctgcaacctgaagattttgcaacttacttctgtcaacagagtttcgcttccccctacacttttggccaggggaccaagctggcgatcaaacgaactgtggctgcaccatctgtcttca

SEQ ID NO: 564488 - DNA, 483 bp, Homo sapiens
  misc_feature: HIJSMM301BEXQQ.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcacca

SEQ ID NO: 564489 - DNA, 493 bp, Homo sapiens
  misc_feature: HIJSMM301D90S8.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaaggggaccaagggtggaaatcaaacgaactgtggctgcaccatctgt

SEQ ID NO: 564490 - DNA, 483 bp, Homo sapiens
  misc_feature: HIJSMM301AZAJG.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggtcggcgggaccg

SEQ ID NO: 564491 - DNA, 507 bp, Homo sapiens; identical to SEQ ID NO: 542621
  misc_feature: HIJSMM301ET1YV.4.10.A10.1.454.light.4.raw

SEQ ID NO: 564492 - DNA, 489 bp, Homo sapiens; identical to SEQ ID NO: 535139
  misc_feature: HIJSMM301A5UQM.14.55.E11.1.454.light.4.raw

SEQ ID NO: 564493 - DNA, 506 bp, Homo sapiens
  misc_feature: HIJSMM301APWKF.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggggtttattactgcatgcaagttctacaaaacttcctacacttttggtccaggggaccgaacgctggaggatcaaaacgaaactgtgggcgtgcaa

SEQ ID NO: 564494 - DNA, 490 bp, Homo sapiens; identical to SEQ ID NO: 535526
  misc_feature: HIJSMM301BC5CK.26.78.H01.1.454.light.4.raw

SEQ ID NO: 564495 - DNA, 447 bp, Homo sapiens; identical to SEQ ID NO: 535201
  misc_feature: HIJSMM301BX9VH.18.9.A09.1.454.light.4.raw

SEQ ID NO: 564496 - DNA, 503 bp, Homo sapiens; identical to SEQ ID NO: 552003
  misc_feature: HIJSMM301CPATU.4.6.A06.1.454.light.4.raw

SEQ ID NO: 564497 - DNA, 507 bp, Homo sapiens
  misc_feature: HIJSMM301CJB2P.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 564498 - DNA, 504 bp, Homo sapiens
  misc_feature: HIJSMM301AX3O2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccaaggtggaaatacaaacgaactagtggctgcaccatctgtcttctatcttccccg

SEQ ID NO: 564499 - DNA, 479 bp, Homo sapiens
  misc_feature: HIJSMM301EWYE0.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatacaaacgaactgtggctgcacc

SEQ ID NO: 564500 - DNA, 512 bp, Homo sapiens
  misc_feature: HIJSMM301CNU96.2.21.B10.1.454.light.4.raw
acgctcgacacacgaccggtgctcgatttagtgtcgtcgcaagagggagggggcgtcagaagcagagttctgggtggtctccaccatggcctggacccctcctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccggtcctacgtcagcccaagcgtgccccctcggtcactctcgg

SEQ ID NO: 564501 - DNA, 503 bp, Homo sapiens; identical to SEQ ID NO: 546075
  misc_feature: HIJSMM301BNONF.7.71.G05.1.454.light.4.raw

SEQ ID NO: 564502 - DNA, 512 bp, Homo sapiens
  misc_feature: HIJSMM301DTYG3.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaggtggaagtcaagcgaactgtggctgcaccatctgtcttcatcttcccgccta

SEQ ID NO: 564503 - DNA, 500 bp, Homo sapiens
  misc_feature: HIJSMM301DREJD.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctgggctccaggctgaagacgaggctgattattactgcagctcatatacaggcagcagcactcaggttttcggcgggagggaccgaagctgaccgtcctaggtcagcccaaggctgccccctcggt

SEQ ID NO: 564504 - DNA, 504 bp, Homo sapiens; identical to SEQ ID NO: 538423
  misc_feature: HIJSMM301CGNYO.48.67.G01.1.454.light.4.raw

SEQ ID NO: 564505 - DNA, 490 bp, Homo sapiens; identical to SEQ ID NO: 547085
  misc_feature: HIJSMM301BR8T2.12.51.E07.1.454.light.4.raw

SEQ ID NO: 564506 - DNA, 505 bp, Homo sapiens
  misc_feature: HIJSMM301CJ2RX.2.49.E05.1.454.light.4.raw
acgctcgacacacgaccggtgctcgatttagagcgactagcaacacacaaagggggggaaggctcagcttcagctgtggtagagaagacaggattcaggacaatctccagcatggccggcttccctctcctcctcaccctcctcactcactgtgcagggtccgtgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgctttatgtcttcggaactggggaccacggtcacccgtcctaggt

SEQ ID NO: 564507 - DNA, 500 bp, Homo sapiens; identical to SEQ ID NO: 541872
  misc_feature: HIJSMM301ADZJK.48.82.H05.1.454.light.4.raw

SEQ ID NO: 564508 - DNA, 504 bp, Homo sapiens
  misc_feature: HIJSMM301DN4X4.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagccctggaacctgaagatgctgcagcgtattactgtcatcagactattactttaccggagactttcggccaagggaccaagtggaaatcaaacgaactgtggctgcaccatctgtcttcatcttcccgccat

SEQ ID NO: 564509 - DNA, 302 bp, Homo sapiens
  misc_feature: HIJSMM301C2Q42.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggaactgtggctgcaccatctgtcttcatcttcccgccatctgatagtacgtga

SEQ ID NO: 564510 - DNA, 487 bp, Homo sapiens; identical to SEQ ID NO: 544897
  misc_feature: HIJSMM301BYKWZ.46.35.D02.1.454.light.4.raw

SEQ ID NO: 564511 - DNA, 497 bp, Homo sapiens
  misc_feature: HIJSMM301BXZCT.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaactagtggctgcaccatctgtcttcatt

SEQ ID NO: 564512 - DNA, 490 bp, Homo sapiens
  misc_feature: HIJSMM301DPGWH.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagagtcaaacgaa

SEQ ID NO: 564513 - DNA, 502 bp, Homo sapiens
  misc_feature: HIJSMM301CRMQ7.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctttgatgcatccatcagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttcatcttcccgccta

SEQ ID NO: 564514 - DNA, 487 bp, Homo sapiens; identical to SEQ ID NO: 539157
  misc_feature: HIJSMM301D7IWF.26.37.D04.1.454.light.4.raw

SEQ ID NO: 564515 - DNA, 435 bp, Homo sapiens
  misc_feature: HIJSMM301BFIU8.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatttcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattaataatacttattcgtacacttttggccaggggaccaagctggagatcaaacgaactgtggctgcaccatctgtcttcatcttcccgccatctgacatactcgta

SEQ ID NO: 564516 - DNA, 499 bp, Homo sapiens
  misc_feature: HIJSMM301B9A26.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcgccgaaggaccgaaacgtaggacgaatcaagcgaactagtggcgtgcgaccactctgtt

SEQ ID NO: 564517 - DNA, 484 bp, Homo sapiens
  misc_feature: HIJSMM301EW64P.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgctaacttattactgtctacaagattacacttaccctgggacgttcggccaagggaccaaggtaggaaatacaaacgaactgtggctgcaccta

SEQ ID NO: 564518 - DNA, 491 bp, Homo sapiens; identical to SEQ ID NO: 535176
  misc_feature: HIJSMM301DVVWB.13.39.D06.1.454.light.4.raw

SEQ ID NO: 564519 - DNA, 492 bp, Homo sapiens
  misc_feature: HIJSMM301BKBS1.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggaccgttcggtccaggggaccgaacggtggaaatcaaacgaactagtggctgcacca

SEQ ID NO: 564520 - DNA, 503 bp, Homo sapiens
  misc_feature: HIJSMM301CGCI4.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggt

SEQ ID NO: 564521 - DNA, 507 bp, Homo sapiens
  misc_feature: HIJSMM301D2AXY.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggt

SEQ ID NO: 564522 - DNA, 507 bp, Homo sapiens
  misc_feature: HIJSMM301DVC34.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggaccaggctgaccgtctaagtcagcccaaggctgcccccc

SEQ ID NO: 564523 - DNA, 505 bp, Homo sapiens
  misc_feature: HIJSMM301AENCF.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtactttttcggggttttcggtcgggagggaccgaacgctgaccgtcctaggtcagcccaacggctgccccctccggt

SEQ ID NO: 564524 - DNA, 476 bp, Homo sapiens; identical to SEQ ID NO: 548126
  misc_feature: HIJSMM301DC72U.4.10.A10.1.454.light.4.raw

SEQ ID NO: 564525 - DNA, 497 bp, Homo sapiens
  misc_feature: HIJSMM301AJGWP.3.3.A03.1.454.light.4.raw
agacgcactccacgaccggtgctcgatttagagagcgtcacagggcacgaccggtgctcgatttagagagcgtcacaggggagagtgttagagggagaagtgcccccacgggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggtacgg

SEQ ID NO: 564526 - DNA, 506 bp, Homo sapiens; identical to SEQ ID NO: 535058
  misc_feature: HIJSMM301ENLFI.17.41.D08.1.454.light.4.raw

SEQ ID NO: 564527 - DNA, 506 bp, Homo sapiens
  misc_feature: HIJSMM301B79IW.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactcc

SEQ ID NO: 564528 - DNA, 484 bp, Homo sapiens
  misc_feature: HIJSMM301BVFW1.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattacctcgaacgttcggccaagggaccaaggtggaagtacaaacgaaactagtggcgtgcaccat

SEQ ID NO: 564529 - DNA, 491 bp, Homo sapiens
  misc_feature: HIJSMM301AIBIJ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatacaaacgaacc

SEQ ID NO: 564530 - DNA, 483 bp, Homo sapiens
  misc_feature: HIJSMM301D2HLI.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggatttgcaacttattactgccagcagtataatgattaccctatcaccttcggccggggacacggctggaaactaacgaactgtggctgcacca

SEQ ID NO: 564531 - DNA, 507 bp, Homo sapiens; identical to SEQ ID NO: 535641
  misc_feature: HIJSMM301ASJZ2.10.88.H11.1.454.light.4.raw

SEQ ID NO: 564532 - DNA, 503 bp, Homo sapiens; identical to SEQ ID NO: 536834
  misc_feature: HIJSMM301BSEBJ.2.35.D02.1.454.light.4.raw

SEQ ID NO: 564533 - DNA, 477 bp, Homo sapiens
  misc_feature: HIJSMM301CR9J4.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactagtggctgcaccat

SEQ ID NO: 564534 - DNA, 471 bp, Homo sapiens
  misc_feature: HIJSMM301D5X92.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagattttcactctcgccatcagtagtctgcaacctgatgattttgcaacttactactgtcaacagagttccactaccccaatcactttcggccctggactgaagtgcatatgaagagaactgtgg

SEQ ID NO: 564535 - DNA, 507 bp, Homo sapiens
  misc_feature: HIJSMM301ASLQ8.8.1.A01.1.454.light.4.raw
  modified_base (501)..(501): a, c, t, g, unknown or other
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccnccctcc

SEQ ID NO: 564536 - DNA, 492 bp, Homo sapiens; identical to SEQ ID NO: 537395
  misc_feature: HIJSMM301BDS0P.16.73.G07.1.454.light.4.raw

SEQ ID NO: 564537 - DNA, 484 bp, Homo sapiens; identical to SEQ ID NO: 535400
  misc_feature: HIJSMM301DCPY5.46.26.C04.1.454.light.4.raw

SEQ ID NO: 564538 - DNA, 492 bp, Homo sapiens
  misc_feature: HIJSMM301AKPZY.48.34.D01.1.454.light.4.raw
agtatacatacacgaccggtgctcgatttagatcgtctgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 564539 - DNA, 444 bp, Homo sapiens
  misc_feature: HIJSMM301AEPXE.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcgaccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctctgtcgagcgt

SEQ ID NO: 564540 - DNA, 495 bp, Homo sapiens
  misc_feature: HIJSMM301D9MKB.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatacaaacgaaactgtggctgcaccatctgtcttcatcttcccg

SEQ ID NO: 564541 - DNA, 499 bp, Homo sapiens; identical to SEQ ID NO: 536030
  misc_feature: HIJSMM301A1667.48.23.C01.1.454.light.4.raw

SEQ ID NO: 564542 - DNA, 505 bp, Homo sapiens
  misc_feature: HIJSMM301CLPNX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccgaaggtaggaaatacaaacgaactgtaggctgcaccatctgtcttcatcttccccg

SEQ ID NO: 564543 - DNA, 495 bp, Homo sapiens
  misc_feature: HIJSMM301BSOC2.51.28.C06.1.454.light.4.raw
cgatcgtatacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 564544 - DNA, 447 bp, Homo sapiens; identical to SEQ ID NO: 535201
  misc_feature: HIJSMM301AP8MR.18.9.A09.1.454.light.4.raw

SEQ ID NO: 564545 - DNA, 505 bp, Homo sapiens; identical to SEQ ID NO: 546412
  misc_feature: HIJSMM301D7A0G.22.21.B10.1.454.light.4.raw

SEQ ID NO: 564546 - DNA, 513 bp, Homo sapiens
  misc_feature: HIJSMM301ANB8L.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaacgggaccgaaggtaggaaagtacaaacgaaactagtggctgcaccatctgtcttctatcttccccg

SEQ ID NO: 564547 - DNA, 536 bp, Homo sapiens
  misc_feature: HIJSMM301C9OKN.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggaggggacccaaaggtagtggaagtactaaaccgaaaaccgtaacgttggtcggtcgtcgacccaaacctacttcgttcgttt

SEQ ID NO: 564548 - DNA, 493 bp, Homo sapiens
  misc_feature: HIJSMM301AF97J.51.35.D02.1.454.light.4.raw
  modified_base (463)..(463): a, c, t, g, unknown or other
cgatcgtatacacgaccggtgctcgatttagcacacgatagttgggtttgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactncgaccaaggtcaccgtcctgggtcagcccc

SEQ ID NO: 564549 - DNA, 503 bp, Homo sapiens; identical to SEQ ID NO: 555460
  misc_feature: HIJSMM301AX4M3.8.42.D09.1.454.light.4.raw

SEQ ID NO: 564550 - DNA, 528 bp, Homo sapiens
  misc_feature: HIJSMM301CEKX1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtcgtaccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcgtccacgggacgaacggtaggaaggtacgaaacgaaactagtaggcgtgcgaccactactcgtcttctactcttccgtccctactctct

SEQ ID NO: 564551 - DNA, 482 bp, Homo sapiens
  misc_feature: HIJSMM301AXBEF.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaactgtggctgcacat

SEQ ID NO: 564552 - DNA, 506 bp, Homo sapiens; identical to SEQ ID NO: 537290
  misc_feature: HIJSMM301BX22I.13.11.A11.1.454.light.4.raw

SEQ ID NO: 564553 - DNA, 519 bp, Homo sapiens
  misc_feature: HIJSMM301B0CB7.14.78.H01.1.454.light.4.raw
cgtctagtaccacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcgggagggaccaagttgaccgtcctaagtcagccaagctgccccctcggtcactctcgttccccg

SEQ ID NO: 564554 - DNA, 504 bp, Homo sapiens
  misc_feature: HIJSMM301D9RIR.48.68.G02.1.454.light.4.raw
agtatacatacacgaccggtgctcgatttagtcgatagtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatacaaacgaactagtggctgcaccatct

SEQ ID NO: 564555 - DNA, 489 bp, Homo sapiens
  misc_feature: HIJSMM301AR8MR.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcatt

SEQ ID NO: 564556 - DNA, 479 bp, Homo sapiens; identical to SEQ ID NO: 538734
  misc_feature: HIJSMM301CNCEI.8.53.E09.1.454.light.4.raw

SEQ ID NO: 564557 - DNA, 486 bp, Homo sapiens; identical to SEQ ID NO: 535043
  misc_feature: HIJSMM301EFLXX.46.35.D02.1.454.light.4.raw

SEQ ID NO: 564558 - DNA, 477 bp, Homo sapiens
  misc_feature: HIJSMM301CKVC6.49.72.G06.1.454.light.4.raw
agtcgagagacacgaccggtgctcgatttagctacgactgcaagggaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccactcggcctcctggccatcactgggctccaggctgaagatgaggctgattatactgccagtcctatgacagcaccatgagtcgttccgtggtcttcggcggagggaccc

SEQ ID NO: 564559 - DNA, 487 bp, Homo sapiens
  misc_feature: HIJSMM301B57JZ.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccagggaccaaggtggaatacaacgaactgtggctgcaccatctgtcttcta

SEQ ID NO: 564560 - DNA, 503 bp, Homo sapiens; identical to SEQ ID NO: 538884
  misc_feature: HIJSMM301AUJHL.27.78.H01.1.454.light.4.raw

SEQ ID NO: 564561 - DNA, 512 bp, Homo sapiens
  misc_feature: HIJSMM301BIKZW.41.9.A09.1.454.light.4.raw
tctatactatcacgaccggtgctcgatttagcgagacgcgcaggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactc

SEQ ID NO: 564562 - DNA, 440 bp, Homo sapiens
  misc_feature: HIJSMM301D4VP0.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcccgtatctctcg

SEQ ID NO: 564563 - DNA, 477 bp, Homo sapiens
  misc_feature: HIJSMM301CIU1R.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttccgccta

SEQ ID NO: 564564 - DNA, 502 bp, Homo sapiens
  misc_feature: HIJSMM301CW2HC.52.34.D01.1.454.light.4.raw
cgcagtacgacacgaccggtgctcgatttagatcgtctgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgctagtttattactgtcagcagcgtagcaactggcctccgatcaccttcggccaagggacacgactggagattaaacggaactgtggctgcaccatctgtcttcatt

SEQ ID NO: 564565 - DNA, 509 bp, Homo sapiens
  misc_feature: HIJSMM301BOJOP.43.67.G01.1.454.light.4.raw
tgtgagtagtcacgaccggtgctcgatttagagtatacatattgggtttggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatcaaacgaactagtggctgcaccatctgtcttcatt

SEQ ID NO: 564566 - DNA, 517 bp, Homo sapiens
  misc_feature: HIJSMM301EEUPG.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaacccca

SEQ ID NO: 564567 - DNA, 484 bp, Homo sapiens; identical to SEQ ID NO: 535400
  misc_feature: HIJSMM301CC0R6.46.26.C04.1.454.light.4.raw

SEQ ID NO: 564568 - DNA, 486 bp, Homo sapiens; identical to SEQ ID NO: 535043
  misc_feature: HIJSMM301BFW4G.46.35.D02.1.454.light.4.raw

SEQ ID NO: 564569 - DNA, 477 bp, Homo sapiens
  misc_feature: HIJSMM301BRD28.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaacgctcctgatctacgatgcatccaatttggaaacaggggtcccatcaaggttcagtggaagtggatctgggacagattttactttctaccatcagcagcctgcagcctgaagatattgcaacatattactgtcagcagtatgataatctcccgatcaccttcggccaagggacacgactggagattaaacgaactgtggctgcacc

SEQ ID NO: 564570 - DNA, 494 bp, Homo sapiens
  misc_feature: HIJSMM301EEZR9.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacttcggccaagggaccaaggtggaaatgaaaggaactgtggctgcaccatctgtctt

SEQ ID NO: 564571 - DNA, 488 bp, Homo sapiens; identical to SEQ ID NO: 535081
  misc_feature: HIJSMM301BS060.26.23.C01.1.454.light.4.raw

SEQ ID NO: 564572 - DNA, 511 bp, Homo sapiens
  misc_feature: HIJSMM301B28J5.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcctcgctacg

SEQ ID NO: 564573 - DNA, 485 bp, Homo sapiens; identical to SEQ ID NO: 542735
  misc_feature: HIJSMM301AOC0Y.26.45.E01.1.454.light.4.raw

SEQ ID NO: 564574 - DNA, 503 bp, Homo sapiens; identical to SEQ ID NO: 538973
  misc_feature: HIJSMM301E4QHX.5.86.H09.1.454.light.4.raw

SEQ ID NO: 564575 - DNA, 444 bp, Homo sapiens; identical to SEQ ID NO: 536685
  misc_feature: HIJSMM301CXCRB.10.76.G10.1.454.light.4.raw

SEQ ID NO: 564576 - DNA, 489 bp, Homo sapiens; identical to SEQ ID NO: 535139
  misc_feature: HIJSMM301CB2JJ.14.55.E11.1.454.light.4.raw

SEQ ID NO: 564577 - DNA, 493 bp, Homo sapiens; identical to SEQ ID NO: 537422
  misc_feature: HIJSMM301EW8ZJ.9.34.D01.1.454.light.4.raw

SEQ ID NO: 564578 - DNA, 508 bp, Homo sapiens; identical to SEQ ID NO: 535649
  misc_feature: HIJSMM301AVDUI.47.55.E11.1.454.light.4.raw

SEQ ID NO: 564579 - DNA, 442 bp, Homo sapiens
  misc_feature: HIJSMM301B1JC3.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccaccctcctcgtactagacg

SEQ ID NO: 564580 - DNA, 486 bp, Homo sapiens
  misc_feature: HIJSMM301CB4TV.3.10.A10.1.454.light.4.raw
agacgcactccacgaccggtgctcgatttagcgtcgatctcagggggtgggtccaggaggcagaactctgggtgcctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 564581 - DNA, 487 bp, Homo sapiens
  misc_feature: HIJSMM301BGVNS.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaaactgtggctgcaccatctgtt

SEQ ID NO: 564582 - DNA, 488 bp, Homo sapiens
  misc_feature: HIJSMM301E3U0N.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccaccttttggccaggggaccgaaagctggagatcaggcgaa

SEQ ID NO: 564583 - DNA, 483 bp, Homo sapiens
  misc_feature: HIJSMM301B9N75.52.5.A05.1.454.light.4.raw
cgcagtacgacacgaccggtgctcgatttagatagatagacaggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctcggtca

SEQ ID NO: 564584 - DNA, 498 bp, Homo sapiens
  misc_feature: HIJSMM301CTDE8.41.35.D02.1.454.light.4.raw
tctatactatcacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 564585 - DNA, 517 bp, Homo sapiens
  misc_feature: HIJSMM301C2CK2.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctcctcacta

SEQ ID NO: 564586 - DNA, 488 bp, Homo sapiens
  misc_feature: HIJSMM301BIKOF.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttggccaagggaccaaggtaggatatcagacgaaa

SEQ ID NO: 564587 - DNA, 492 bp, Homo sapiens; identical to SEQ ID NO: 544532
  misc_feature: HIJSMM301AM0PO.8.81.H04.1.454.light.4.raw

SEQ ID NO: 564588 - DNA, 486 bp, Homo sapiens; identical to SEQ ID NO: 538674
  misc_feature: HIJSMM301EE8WZ.47.38.D05.1.454.light.4.raw

SEQ ID NO: 564589 - DNA, 488 bp, Homo sapiens; identical to SEQ ID NO: 535990
  misc_feature: HIJSMM301A1IQM.11.28.C06.1.454.light.4.raw

SEQ ID NO: 564590 - DNA, 482 bp, Homo sapiens
  misc_feature: HIJSMM301BE5AV.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcgggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 564591 - DNA, 515 bp, Homo sapiens
  misc_feature: HIJSMM301EL7QP.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccacctcctcacg

SEQ ID NO: 564592 - DNA, 479 bp, Homo sapiens; identical to SEQ ID NO: 548655
  misc_feature: HIJSMM301CCDE3.48.5.A05.1.454.light.4.raw

SEQ ID NO: 564593 - DNA, 494 bp, Homo sapiens; identical to SEQ ID NO: 534994
  misc_feature: HIJSMM301D662M.27.78.H01.1.454.light.4.raw

SEQ ID NO: 564594 - DNA, 505 bp, Homo sapiens; identical to SEQ ID NO: 536117
  misc_feature: HIJSMM301CQVPZ.8.71.G05.1.454.light.4.raw

SEQ ID NO: 564595 - DNA, 494 bp, Homo sapiens
  misc_feature: HIJSMM301COCVA.48.33.C11.1.454.light.4.raw
agtatacatacacgaccggtgctcgatttagagtgagctcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgatgctgattattactgcagctcatatgcaggcagcaacaatgtggtattcggcggagggaccaagctgaccgtcctaggtcagcccaagg

SEQ ID NO: 564596 - DNA, 495 bp, Homo sapiens
  misc_feature: HIJSMM301DIKLB.5.12.B01.1.454.light.4.raw
atcagacacgcacgaccggtgctcgatttagtagtgtagattccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtctgagtcagccaaggctccg

SEQ ID NO: 564597 - DNA, 466 bp, Homo sapiens; identical to SEQ ID NO: 535366
  misc_feature: HIJSMM301DBTMN.13.4.A04.1.454.light.4.raw

SEQ ID NO: 564598 - DNA, 505 bp, Homo sapiens; identical to SEQ ID NO: 536117
  misc_feature: HIJSMM301CK44A.8.71.G05.1.454.light.4.raw

SEQ ID NO: 564599 - DNA, 499 bp, Homo sapiens
  misc_feature: HIJSMM301BHZ5D.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcggtcggagggaccgaacggacgggacggatcagaacgaactagtggctgcaccactctgtcttcta

SEQ ID NO: 564600 - DNA, 495 bp, Homo sapiens
  misc_feature: HIJSMM301AE56Z.41.53.E09.1.454.light.4.raw
tctatactatcacgaccggtgctcgatttagagagagtgtgttgggtttgggcagaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattc

SEQ ID NO: 564601 - DNA, 496 bp, Homo sapiens; identical to SEQ ID NO: 563968
  misc_feature: HIJSMM301DET4N.15.81.H04.1.454.light.4.raw

SEQ ID NO: 564602 - DNA, 444 bp, Homo sapiens; identical to SEQ ID NO: 535192
  misc_feature: HIJSMM301CF6Y5.5.9.A09.1.454.light.4.raw

SEQ ID NO: 564603 - DNA, 503 bp, Homo sapiens; identical to SEQ ID NO: 545496
  misc_feature: HIJSMM301DR3KI.8.24.C02.1.454.light.4.raw

SEQ ID NO: 564604 - DNA, 494 bp, Homo sapiens; identical to SEQ ID NO: 534992
  misc_feature: HIJSMM301C405H.9.1.A01.1.454.light.4.raw

SEQ ID NO: 564605 - DNA, 501 bp, Homo sapiens; identical to SEQ ID NO: 536142
  misc_feature: HIJSMM301EI1YM.15.1.A01.1.454.light.4.raw

SEQ ID NO: 564606 - DNA, 504 bp, Homo sapiens
  misc_feature: HIJSMM301C2DME.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggtcaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctcggtcta

SEQ ID NO: 564607 - DNA, 495 bp, Homo sapiens
  misc_feature: HIJSMM301CH2BB.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtactttggccaggggaccaagctggagatcaaacgaactgtggctgcaccatctgtcttcta

SEQ ID NO: 564608 - DNA, 488 bp, Homo sapiens
  misc_feature: HIJSMM301BS6O2.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgtccacttttggccaggggaccaagctggagatcaggcgaacg

SEQ ID NO: 564609 - DNA, 509 bp, Homo sapiens
  misc_feature: HIJSMM301BHHHH.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttggcccccctgggaccgaaacgtaggagtatcaaacgaacctagtggctgcaccactctgtcttctatcttcccgtccact

SEQ ID NO: 564610 - DNA, 490 bp, Homo sapiens; identical to SEQ ID NO: 535420
  misc_feature: HIJSMM301AG7AS.3.72.G06.1.454.light.4.raw

SEQ ID NO: 564611 - DNA, 485 bp, Homo sapiens
  misc_feature: HIJSMM301CYOFU.47.46.E02.1.454.light.4.raw
  modified_base (474)..(474): a, c, t, g, unknown or other
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgnggctgcaccat

SEQ ID NO: 564612 - DNA, 497 bp, Homo sapiens; identical to SEQ ID NO: 535740
  misc_feature: HIJSMM301A57D9.3.71.G05.1.454.light.4.raw

SEQ ID NO: 564613 - DNA, 504 bp, Homo sapiens
  misc_feature: HIJSMM301ETL88.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcg

SEQ ID NO: 564614 - DNA, 447 bp, Homo sapiens; identical to SEQ ID NO: 535201
  misc_feature: HIJSMM301DMSGS.18.9.A09.1.454.light.4.raw

SEQ ID NO: 564615 - DNA, 494 bp, Homo sapiens; identical to SEQ ID NO: 535680
  misc_feature: HIJSMM301C7KX2.16.78.H01.1.454.light.4.raw

SEQ ID NO: 564616 - DNA, 484 bp, Homo sapiens
  misc_feature: HIJSMM301CJ0GU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaacgaaa

SEQ ID NO: 564617 - DNA, 502 bp, Homo sapiens
  misc_feature: HIJSMM301D973U.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgagtcaggcactgatttcacactggaaatcagcagggtggaggctgaggatgttggggtttattactgcatgcaaactacacacggccgctcactttcgggcggagggaccaaggtggagatcaaacgaactgtggctgcaccat

SEQ ID NO: 564618 - DNA, 486 bp, Homo sapiens; identical to SEQ ID NO: 535043
  misc_feature: HIJSMM301AH5CL.46.35.D02.1.454.light.4.raw

SEQ ID NO: 564619 - DNA, 502 bp, Homo sapiens
  misc_feature: HIJSMM301CR2RS.4.37.D04.1.454.light.4.raw
agcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaaa

SEQ ID NO: 564620 - DNA, 499 bp, Homo sapiens
  misc_feature: HIJSMM301D434T.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactagtggctgcaccatctgtcttcatcttccccg

SEQ ID NO: 564621 - DNA, 482 bp, Homo sapiens; identical to SEQ ID NO: 535352
  misc_feature: HIJSMM301DMZ91.16.81.H04.1.454.light.4.raw

SEQ ID NO: 564622 - DNA, 506 bp, Homo sapiens
  misc_feature: HIJSMM301BAL2H.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgatttattactgtgcaggatgggatgacaacctgggtgcttatctcttcggacctgggaccaaggtcaccgtcttggtc

SEQ ID NO: 564623 - DNA, 492 bp, Homo sapiens; identical to SEQ ID NO: 545637
  misc_feature: HIJSMM301DJYP7.48.1.A01.1.454.light.4.raw

SEQ ID NO: 564624 - DNA, 456 bp, Homo sapiens
  misc_feature: HIJSMM301BH63N.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgatttctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgtttcccaccctcctccacgagagta

SEQ ID NO: 564625 - DNA, 506 bp, Homo sapiens
  misc_feature: HIJSMM301B0724.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaatacaaacgaactagtggctgcaccatctgtcttcatcttccccg

SEQ ID NO: 564626 - DNA, 496 bp, Homo sapiens; identical to SEQ ID NO: 553382
  misc_feature: HIJSMM301CGD5H.51.59.F04.1.454.light.4.raw

SEQ ID NO: 564627 - DNA, 493 bp, Homo sapiens; identical to SEQ ID NO: 535084
  misc_feature: HIJSMM301BJ7QM.47.64.F09.1.454.light.4.raw

SEQ ID NO: 564628 - DNA, 498 bp, Homo sapiens
  misc_feature: HIJSMM301C7HPU.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacatctctgggctccaggctgaggacgaggctgattattattgctgctcatatgcaggtagttacacttatgtcttcggaattgggacgacggtcaccgtcctaggtcacgcccaaggccaaccc

SEQ ID NO: 564629 - DNA, 494 bp, Homo sapiens; identical to SEQ ID NO: 534992
  misc_feature: HIJSMM301DGO7Y.9.1.A01.1.454.light.4.raw

SEQ ID NO: 564630 - DNA, 486 bp, Homo sapiens; identical to SEQ ID NO: 535290
  misc_feature: HIJSMM301AMV7H.3.12.B01.1.454.light.4.raw

SEQ ID NO: 564631 - DNA, 491 bp, Homo sapiens; identical to SEQ ID NO: 556065
  misc_feature: HIJSMM301EA2IL.47.78.H01.1.454.light.4.raw

SEQ ID NO: 564632 - DNA, 485 bp, Homo sapiens
  misc_feature: HIJSMM301C16FC.10.35.D02.1.454.light.4.raw
catagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggtaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacc

SEQ ID NO: 564633 - DNA, 492 bp, Homo sapiens
  misc_feature: HIJSMM301AIEPQ.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttccccaccctcctctacgtgagct

SEQ ID NO: 564634 - DNA, 488 bp, Homo sapiens
  misc_feature: HIJSMM301CQQ97.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccacgggtggaaatcaaacgaactagtggctgcaccatcttcg

SEQ ID NO: 564635 - DNA, 486 bp, Homo sapiens; identical to SEQ ID NO: 535043
  misc_feature: HIJSMM301D3QNV.46.35.D02.1.454.light.4.raw

SEQ ID NO: 564636 - DNA, 485 bp, Homo sapiens; identical to SEQ ID NO: 564611
  misc_feature: HIJSMM301CWLAY.47.46.E02.1.454.light.4.raw
  modified_base (474)..(474): a, c, t, g, unknown or other

SEQ ID NO: 564637 - DNA, 515 bp, Homo sapiens; identical to SEQ ID NO: 549132
  misc_feature: HIJSMM301BRWOU.9.14.B03.1.454.light.4.raw

SEQ ID NO: 564638 - DNA, 520 bp, Homo sapiens
  misc_feature: HIJSMM301CQ7KW.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 564639 - DNA, 520 bp, Homo sapiens
  misc_feature: HIJSMM301C8YX7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaacgggaccgaacggtaggaagtacgaaacgaacgtagtggcgtgcaccactctcgtcttctatcttcccgtcctact

SEQ ID NO: 564640 - DNA, 500 bp, Homo sapiens
  misc_feature: HIJSMM301DJBJF.43.71.G05.1.454.light.4.raw
tgtgagtagtcacgaccggtgctcgatttagtgtcgtcgcaagagagaggggggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaacta

SEQ ID NO: 564641 - DNA, 486 bp, Homo sapiens; identical to SEQ ID NO: 537310
  misc_feature: HIJSMM301DLO4R.15.28.C06.1.454.light.4.raw

SEQ ID NO: 564642 - DNA, 494 bp, Homo sapiens; identical to SEQ ID NO: 535828
  misc_feature: HIJSMM301EMJ7A.3.36.D03.1.454.light.4.raw

SEQ ID NO: 564643 - DNA, 515 bp, Homo sapiens
  misc_feature: HIJSMM301BMTIZ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcctcc

SEQ ID NO: 564644 - DNA, 447 bp, Homo sapiens; identical to SEQ ID NO: 535882
  misc_feature: HIJSMM301COVUN.18.9.A09.1.454.light.4.raw
  modified_base (429)..(429): a, c, t, g, unknown or other

SEQ ID NO: 564645 - DNA, 499 bp, Homo sapiens
  misc_feature: HIJSMM301D5UN1.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggcccaagggacacgactggaaattaaacgaactgtggctgcaccatctgtcttcatcttccccg

SEQ ID NO: 564646 - DNA, 521 bp, Homo sapiens
  misc_feature: HIJSMM301AFJNZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttcggttcgggacgggacggaacggacggacggagtacacgaacggaaccgtaacgtggtcgtcgtcgacccactacttcgttcttctta

SEQ ID NO: 564647 - DNA, 504 bp, Homo sapiens; identical to SEQ ID NO: 543615
  misc_feature: HIJSMM301C39TA.11.67.G01.1.454.light.4.raw

SEQ ID NO: 564648 - DNA, 496 bp, Homo sapiens
  misc_feature: HIJSMM301ET8TD.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctctcagacgttcggccaagggaccaaggtggaaatcaaacgaactgtgctgcacca

SEQ ID NO: 564649 - DNA, 497 bp, Homo sapiens; identical to SEQ ID NO: 535740
  misc_feature: HIJSMM301EFVG1.3.71.G05.1.454.light.4.raw

SEQ ID NO: 564650 - DNA, 506 bp, Homo sapiens
  misc_feature: HIJSMM301EBV2F.10.27.C05.1.454.light.4.raw
catagtagtgcacgaccggtgctcgatttagacgcgatcgaagggtttgggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgcccctcggt

SEQ ID NO: 564651 - DNA, 485 bp, Homo sapiens; identical to SEQ ID NO: 536075
  misc_feature: HIJSMM301B70OJ.17.21.B10.1.454.light.4.raw

SEQ ID NO: 564652 - DNA, 478 bp, Homo sapiens; identical to SEQ ID NO: 557323
  misc_feature: HIJSMM301DOIZ1.48.5.A05.1.454.light.4.raw

SEQ ID NO: 564653 - DNA, 494 bp, Homo sapiens
  misc_feature: HIJSMM301CP2G3.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcaccatctgtcttcatcttcccg

SEQ ID NO: 564654 - DNA, 496 bp, Homo sapiens; identical to SEQ ID NO: 535423
  misc_feature: HIJSMM301AYYJR.3.33.C11.1.454.light.4.raw

SEQ ID NO: 564655 - DNA, 500 bp, Homo sapiens
  misc_feature: HIJSMM301EUGRA.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagccccaaggcccaacccc

SEQ ID NO: 564656 - DNA, 447 bp, Homo sapiens; identical to SEQ ID NO: 535020
  misc_feature: HIJSMM301CECQI.18.9.A09.1.454.light.4.raw

SEQ ID NO: 564657 - DNA, 490 bp, Homo sapiens
  misc_feature: HIJSMM301BBXLE.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgaatttcggtggagggaccaaggtggaggtcaaacgaactgtggctgcaccatctgtcttcatt

SEQ ID NO: 564658 - DNA, 491 bp, Homo sapiens
  misc_feature: HIJSMM301CZNF3.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccggaaggtggaggatacaaacgaaactagttggcgtgcaccaa

SEQ ID NO: 564659 - DNA, 494 bp, Homo sapiens; identical to SEQ ID NO: 535828
  misc_feature: HIJSMM301ERU9Y.3.36.D03.1.454.light.4.raw

SEQ ID NO: 564660 - DNA, 490 bp, Homo sapiens; identical to SEQ ID NO: 535234
  misc_feature: HIJSMM301AZFON.17.21.B10.1.454.light.4.raw

SEQ ID NO: 564661 - DNA, 489 bp, Homo sapiens; identical to SEQ ID NO: 535386
  misc_feature: HIJSMM301D922V.12.51.E07.1.454.light.4.raw

SEQ ID NO: 564662 - DNA, 494 bp, Homo sapiens; identical to SEQ ID NO: 535276
  misc_feature: HIJSMM301B2U4V.16.6.A06.1.454.light.4.raw

SEQ ID NO: 564663 - DNA, 472 bp, Homo sapiens
  misc_feature: HIJSMM301ESDS0.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcacttcgcctggactgaagtgcatatgaagagaactgtggctgca

SEQ ID NO: 564664 - DNA, 489 bp, Homo sapiens
  misc_feature: HIJSMM301BC40J.48.10.A10.1.454.light.4.raw
agtatacatacacgaccggtgctcgatttagcgtcgatctcaggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacaaaattcactctcaccatcagcggcctgcagtctgatgattttgcaacttatttctgccaacagtatcatacttattctcggaccttcggccaagggaccagggtggaaagtacaaacgaactagtggctgcaccatctgtcttcta

SEQ ID NO: 564665 - DNA, 484 bp, Homo sapiens; identical to SEQ ID NO: 535240
  misc_feature: HIJSMM301C5ES5.47.60.F05.1.454.light.4.raw

SEQ ID NO: 564666 - DNA, 478 bp, Homo sapiens
  misc_feature: HIJSMM301ECAEK.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaaattcactctcacaatcaccagcctgcagcctgaagattttgcaacttattactgtcaacaggtttatattaacctcgtatttcggccctgggaccacagtagatatcaaacgaactgtggctgcacc

SEQ ID NO: 564667 - DNA, 441 bp, Homo sapiens
  misc_feature: HIJSMM301CMU1C.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctgccccctcggtcactctgttcccacctcctcgacacggag

SEQ ID NO: 564668 - DNA, 490 bp, Homo sapiens; identical to SEQ ID NO: 538273
  misc_feature: HIJSMM301C2V2B.16.73.G07.1.454.light.4.raw

SEQ ID NO: 564669 - DNA, 485 bp, Homo sapiens; identical to SEQ ID NO: 536263
  misc_feature: HIJSMM301BRQQ8.47.78.H01.1.454.light.4.raw

SEQ ID NO: 564670 - DNA, 487 bp, Homo sapiens
  misc_feature: HIJSMM301C9QJ9.47.70.G04.1.454.light.4.raw
  modified_base (485)..(485): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatcngt

SEQ ID NO: 564671 - DNA, 484 bp, Homo sapiens
  misc_feature: HIJSMM301BAM0B.52.72.G06.1.454.light.4.raw
cgcagtacgacacgaccggtgctcgatttagctacgactgcaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtgcgtcccatcgaggttcagtggccggggatctgggacagacttcactctcaccatcagcggtcttcaacctgaggactttggaacttactactgtcagcagagtgataatacccctcagactttcggccctcgggactacagtggatgtcaaacgaactgtggctgcaccat

SEQ ID NO: 564672 - DNA, 495 bp, Homo sapiens
  misc_feature: HIJSMM301CUO3K.7.75.G09.1.454.light.4.raw
  modified_base (476)..(476): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggatttttgcaacttactaactgtcagcaggctaacaggctgcccccaaccttcggccaggggacgacgacctggaggattaaaacgaaactntggctgcaccaactctgtt

SEQ ID NO: 564673 - DNA, 492 bp, Homo sapiens
  misc_feature: HIJSMM301EX1QA.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggttcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccg

SEQ ID NO: 564674 - DNA, 478 bp, Homo sapiens; identical to SEQ ID NO: 535449
  misc_feature: HIJSMM301EB9N8.40.59.F04.1.454.light.4.raw

SEQ ID NO: 564675 - DNA, 500 bp, Homo sapiens
  misc_feature: HIJSMM301AHOS1.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccca

SEQ ID NO: 564676 - DNA, 489 bp, Homo sapiens
  misc_feature: HIJSMM301CBL3Z.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcacttttcggcggagggaccaaggtggaggatcaaacgaactgtggctgcaccatct

SEQ ID NO: 564677 - DNA, 521 bp, Homo sapiens; identical to SEQ ID NO: 539470
  misc_feature: HIJSMM301EL9RZ.27.23.C01.1.454.light.4.raw

SEQ ID NO: 564678 - DNA, 493 bp, Homo sapiens
  misc_feature: HIJSMM301EPON8.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattccctccgacgttcggccaaggaccaaggtggaagtcagacgaactgtgctgcaccatctgtcttcat

SEQ ID NO: 564679 - DNA, 505 bp, Homo sapiens; identical to SEQ ID NO: 536254
  misc_feature: HIJSMM301A2ZUW.7.71.G05.1.454.light.4.raw

SEQ ID NO: 564680 - DNA, 493 bp, Homo sapiens; identical to SEQ ID NO: 544835
  misc_feature: HIJSMM301AN297.43.29.C07.1.454.light.4.raw

SEQ ID NO: 564681 - DNA, 511 bp, Homo sapiens
  misc_feature: HIJSMM301A4KV4.40.14.B03.1.454.light.4.raw
tctagcgactcacgaccggtgctcgatttagtgtgagtagttccgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgtt

SEQ ID NO: 564682 - DNA, 488 bp, Homo sapiens; identical to SEQ ID NO: 539612
  misc_feature: HIJSMM301CZLCE.3.55.E11.1.454.light.4.raw

SEQ ID NO: 564683 - DNA, 501 bp, Homo sapiens; identical to SEQ ID NO: 550139
  misc_feature: HIJSMM301EP9C9.15.56.F01.1.454.light.4.raw

SEQ ID NO: 564684 - DNA, 479 bp, Homo sapiens; identical to SEQ ID NO: 536050
  misc_feature: HIJSMM301AV38R.5.73.G07.1.454.light.4.raw

SEQ ID NO: 564685 - DNA, 494 bp, Homo sapiens; identical to SEQ ID NO: 534992
  misc_feature: HIJSMM301EA3QK.9.1.A01.1.454.light.4.raw

SEQ ID NO: 564686 - DNA, 489 bp, Homo sapiens; identical to SEQ ID NO: 535139
  misc_feature: HIJSMM301CVA5R.14.55.E11.1.454.light.4.raw

SEQ ID NO: 564687 - DNA, 499 bp, Homo sapiens
  misc_feature: HIJSMM301DJXYQ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaacccca

SEQ ID NO: 564688 - DNA, 493 bp, Homo sapiens
  misc_feature: HIJSMM301ER3A2.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggaccaagggaccaaggtggaaatcaagacgaactgtggctgcaccatctgtcttcta

SEQ ID NO: 564689 - DNA, 477 bp, Homo sapiens
  misc_feature: HIJSMM301CFJ1T.7.83.H06.1.454.light.4.raw
  modified_base (437)..(437): a, c, t, g, unknown or other
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgnggtgtggtgatcggcggaggaccaggctgaccgtctaggt

SEQ ID NO: 564690 - DNA, 484 bp, Homo sapiens; identical to SEQ ID NO: 535400
  misc_feature: HIJSMM301EQCTW.46.26.C04.1.454.light.4.raw

SEQ ID NO: 564691 - DNA, 494 bp, Homo sapiens; identical to SEQ ID NO: 539894
  misc_feature: HIJSMM301DLIQ3.16.53.E09.1.454.light.4.raw

SEQ ID NO: 564692 - DNA, 494 bp, Homo sapiens; identical to SEQ ID NO: 534992
  misc_feature: HIJSMM301DO293.9.1.A01.1.454.light.4.raw

SEQ ID NO: 564693 - DNA, 486 bp, Homo sapiens; identical to SEQ ID NO: 537310
  misc_feature: HIJSMM301A4A1W.15.28.C06.1.454.light.4.raw

SEQ ID NO: 564694 - DNA, 482 bp, Homo sapiens; identical to SEQ ID NO: 535216
  misc_feature: HIJSMM301BBDPA.17.26.C04.1.454.light.4.raw

SEQ ID NO: 564695 - DNA, 491 bp, Homo sapiens
  misc_feature: HIJSMM301A3CTX.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccgagggaccgaaggtcgaaatagagacgaactggtggcgtgccacatcttcg

SEQ ID NO: 564696 - DNA, 507 bp, Homo sapiens
  misc_feature: HIJSMM301CB70U.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagtttcctttttgttcttcggtaactgggaccgaggtccaccgtcctaggtcagcccaaggccaaccccactgtcta

SEQ ID NO: 564697 - DNA, 483 bp, Homo sapiens
  misc_feature: HIJSMM301B37JR.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccat

SEQ ID NO: 564698 - DNA, 494 bp, Homo sapiens; identical to SEQ ID NO: 535828
  misc_feature: HIJSMM301BNZQT.3.36.D03.1.454.light.4.raw

SEQ ID NO: 564699 - DNA, 496 bp, Homo sapiens; identical to SEQ ID NO: 535109
  misc_feature: HIJSMM301D0BLF.16.78.H01.1.454.light.4.raw

SEQ ID NO: 564700 - DNA, 506 bp, Homo sapiens; identical to SEQ ID NO: 554189
  misc_feature: HIJSMM301AZC58.19.78.H01.1.454.light.4.raw

SEQ ID NO: 564701 - DNA, 496 bp, Homo sapiens; identical to SEQ ID NO: 537513
  misc_feature: HIJSMM301DDGRJ.12.87.H10.1.454.light.4.raw

SEQ ID NO: 564702 - DNA, 491 bp, Homo sapiens; identical to SEQ ID NO: 538021
  misc_feature: HIJSMM301BBMR1.3.72.G06.1.454.light.4.raw

SEQ ID NO: 564703 - DNA, 497 bp, Homo sapiens
  misc_feature: HIJSMM301C7H8J.41.20.B09.1.454.light.4.raw
tctatactatcacgaccggtgctcgatttagtgtagtgtgaaggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggcccatcaagatttagtggctttggaactgggacggagttcactctcaccatcaccggcctgcagcctgatgactttgcaacttattactgccagcaatatgacgtttacccgcttcactttcggcggagggaccaaggtggagatcaaaggaactgtggctgcaccatctgtcttcatcttcccgccta

SEQ ID NO: 564704 - DNA, 510 bp, Homo sapiens
  misc_feature: HIJSMM301AZGRY.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccctcc

SEQ ID NO: 564705 - DNA, 480 bp, Homo sapiens
  misc_feature: HIJSMM301CFBGM.48.5.A05.1.454.light.4.raw
agtatacatacacgaccggtgctcgatttagatagatagacagggcacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaaggaccaa

SEQ ID NO: 564706 - DNA, 494 bp, Homo sapiens
  misc_feature: HIJSMM301C3286.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtctaggtcagcccaaggctgccccctcggtcactctgttcccacctcctcgagtgcgtct

SEQ ID NO: 564707 - DNA, 509 bp, Homo sapiens; identical to SEQ ID NO: 541417
  misc_feature: HIJSMM301CYYBO.16.46.E02.1.454.light.4.raw

SEQ ID NO: 564708 - DNA, 498 bp, Homo sapiens
  misc_feature: HIJSMM301BTUEP.51.12.B01.1.454.light.4.raw
cgatcgtatacacgaccggtgctcgatttagtagtgtagattccgcgggggtgggctcagaagcagagttctggggtgtctccaccatggcctggacccctctctggctcactctcctcactctttgcataggttctgtggtttcttctgagctgactcaggaccctactgtgtctgtggccttggggcagacagtcaggatcacatgccaaggagacaacctcagaatgttttatgcacactggtaccagcataagccaggacaggcccctctacttgtcatctatggtagagacaaccggccctcagggatcccagaccgattctctggctccatctcaggaaacacagcttccttgaccatcactggggctcaggcggaagatgaggctgactattactgtaatacccgggacagcagtgataaggtcatgatattcggcggagggacgaagctgaccgtcctacgtcagcccaaggctgccccctcggtcactc

SEQ ID NO: 564709 - DNA, 445 bp, Homo sapiens; identical to SEQ ID NO: 537719
  misc_feature: HIJSMM301ASB5J.47.85.H08.1.454.light.4.raw

SEQ ID NO: 564710 - DNA, 498 bp, Homo sapiens; identical to SEQ ID NO: 535295
  misc_feature: HIJSMM301B8393.15.25.C03.1.454.light.4.raw

SEQ ID NO: 564711 - DNA, 511 bp, Homo sapiens; identical to SEQ ID NO: 541549
  misc_feature: HIJSMM301D8JQC.40.33.C11.1.454.light.4.raw

SEQ ID NO: 564712 - DNA, 510 bp, Homo sapiens
  misc_feature: HIJSMM301C4MFU.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggccaaggctgaccgtcctcggtcagcccaaggctgtccccccg

SEQ ID NO: 564713 - DNA, 350 bp, Homo sapiens; identical to SEQ ID NO: 537421
  misc_feature: HIJSMM301ED7YN.13.11.A11.1.454.light.4.raw

SEQ ID NO: 564714 - DNA, 496 bp, Homo sapiens; identical to SEQ ID NO: 535612
  misc_feature: HIJSMM301A29FI.22.9.A09.1.454.light.4.raw

SEQ ID NO: 564715 - DNA, 495 bp, Homo sapiens
  misc_feature: HIJSMM301DR03L.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctagttttttactgtcagcagtatagtaactggcctccgtacacttttggccagggaccaagctagaaatcaaacgaactgtggctgcaccatctgtcttca

SEQ ID NO: 564716 - DNA, 498 bp, Homo sapiens; identical to SEQ ID NO: 559536
  misc_feature: HIJSMM301D3B33.40.57.F02.1.454.light.4.raw

SEQ ID NO: 564717 - DNA, 506 bp, Homo sapiens
  misc_feature: HIJSMM301D0MAK.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccaaagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcact

SEQ ID NO: 564718 - DNA, 501 bp, Homo sapiens
  misc_feature: HIJSMM301EB5IZ.16.86.H09.1.454.light.4.raw
tgtactactccacgaccggtgctcgatttagtgctatagacttgggtttgggggctgggggtctcaggaggcagcgctctcaggaccatctccaccagtcggcctgggctctgctgctcctcaccctcctcactcagggcacagggtccgtgggcccagtctgccctgactcagcctgcctccgtgtctgggtcctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctgaggacgagggtgattattactgcacgctcatatagaagtggcagcactctcgtagttcggcggtgggaccaagctgaccgtcctaggtcagcccaagg

SEQ ID NO: 564719 - DNA, 447 bp, Homo sapiens; identical to SEQ ID NO: 535020
  misc_feature: HIJSMM301DH7PK.18.9.A09.1.454.light.4.raw

SEQ ID NO: 564720 - DNA, 493 bp, Homo sapiens
  misc_feature: HIJSMM301DN5H2.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcta

SEQ ID NO: 564721 - DNA, 548 bp, Homo sapiens
  misc_feature: HIJSMM301CNSMV.15.34.D01.1.454.light.4.raw
  modified_base (465)..(465): a, c, t, g, unknown or other
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttactgttgggcggtggtcgattgggttggttcggtcggnggggaaccggaaacctaacgtaccggtaccctacggttacgacgaccaaccggacgtcgcccctcccggtccgtactcttccg

SEQ ID NO: 564722 - DNA, 493 bp, Homo sapiens
  misc_feature: HIJSMM301COA93.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgagatgctgcaacttattactgtcatcagagtactactttacctcaagtgatcaccttcggccaagggacacgactggagattaaacgaactgtggctgcaccatctgtctt

SEQ ID NO: 564723 - DNA, 482 bp, Homo sapiens; identical to SEQ ID NO: 535920
  misc_feature: HIJSMM301AO810.19.71.G05.1.454.light.4.raw

SEQ ID NO: 564724 - DNA, 484 bp, Homo sapiens
  misc_feature: HIJSMM301CNFA2.52.38.D05.1.454.light.4.raw
cgcagtacgacacgaccggtgctcgatttagtatctgatagttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcg

SEQ ID NO: 564725 - DNA, 512 bp, Homo sapiens; identical to SEQ ID NO: 541300
  misc_feature: HIJSMM301EMUQ3.17.33.C11.1.454.light.4.raw

SEQ ID NO: 564726 - DNA, 447 bp, Homo sapiens; identical to SEQ ID NO: 535201
  misc_feature: HIJSMM301AH2JM.18.9.A09.1.454.light.4.raw

SEQ ID NO: 564727 - DNA, 472 bp, Homo sapiens
  misc_feature: HIJSMM301CTG9S.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcagccc

SEQ ID NO: 564728 - DNA, 484 bp, Homo sapiens; identical to SEQ ID NO: 535211
  misc_feature: HIJSMM301CULIW.47.46.E02.1.454.light.4.raw

SEQ ID NO: 564729 - DNA, 486 bp, Homo sapiens
  misc_feature: HIJSMM301DVEGF.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgctaacttactactgtcaacagagttacaggcccccctatacttttggccagggaccaagctggagatcacaggaactgtggctgcacc

SEQ ID NO: 564730 - DNA, 476 bp, Homo sapiens; identical to SEQ ID NO: 537812
  misc_feature: HIJSMM301BXBDJ.3.82.H05.1.454.light.4.raw

SEQ ID NO: 564731 - DNA, 519 bp, Homo sapiens
  misc_feature: HIJSMM301A3ZOK.51.43.D10.1.454.light.4.raw
  modified_base (508)..(508): a, c, t, g, unknown or other
cgatcgtatacacgaccggtgctcgatttagactagcagtaaggggagtctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactcgtcactctgttccccnccctcctctcg

SEQ ID NO: 564732 - DNA, 487 bp, Homo sapiens; identical to SEQ ID NO: 535358
  misc_feature: HIJSMM301CJOMH.47.70.G04.1.454.light.4.raw

SEQ ID NO: 564733 - DNA, 494 bp, Homo sapiens
  misc_feature: HIJSMM301ER11D.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgttctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcact

SEQ ID NO: 564734 - DNA, 513 bp, Homo sapiens
  misc_feature: HIJSMM301DP32S.17.33.C11.1.454.light.4.raw
  modified_base (506)..(506): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccnccctcct

SEQ ID NO: 564735 - DNA, 490 bp, Homo sapiens
  misc_feature: HIJSMM301APXQJ.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcagacacagattttacgctgaaaatcagtagggtggaggctgaggatgttggggtttattactgcatgcaagttctacaaacttcctacacttttggccaggggaccaagctggagatcaaacgaactgtgg

SEQ ID NO: 564736 - DNA, 460 bp, Homo sapiens; identical to SEQ ID NO: 536053
  misc_feature: HIJSMM301CROPM.22.28.C06.1.454.light.4.raw

SEQ ID NO: 564737 - DNA, 502 bp, Homo sapiens
  misc_feature: HIJSMM301CNFRH.41.21.B10.1.454.light.4.raw
tctatactatcacgaccggtgctcgatttagtgtcgtcgcaagagagggggggaggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcagggcattcggcaagggaccaaggtggaaattaaacgaactgtggctgcaccatctgtcttcatcttcccgcca

SEQ ID NO: 564738 - DNA, 447 bp, Homo sapiens; identical to SEQ ID NO: 535882
  misc_feature: HIJSMM301EIE0C.18.9.A09.1.454.light.4.raw
  modified_base (429)..(429): a, c, t, g, unknown or other

SEQ ID NO: 564739 - DNA, 513 bp, Homo sapiens; identical to SEQ ID NO: 552974
  misc_feature: HIJSMM301EQKVT.7.39.D06.1.454.light.4.raw

SEQ ID NO: 564740 - DNA, 486 bp, Homo sapiens; identical to SEQ ID NO: 535043
  misc_feature: HIJSMM301ESC1S.46.35.D02.1.454.light.4.raw

SEQ ID NO: 564741 - DNA, 454 bp, Homo sapiens; identical to SEQ ID NO: 536347
  misc_feature: HIJSMM301CHK9D.19.86.H09.1.454.light.4.raw

SEQ ID NO: 564742 - DNA, 483 bp, Homo sapiens; identical to SEQ ID NO: 536202
  misc_feature: HIJSMM301CCM5A.43.24.C02.1.454.light.4.raw

SEQ ID NO: 564743 - DNA, 478 bp, Homo sapiens
  misc_feature: HIJSMM301CWU45.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggccagggtggaaatcaaacgaactgtggctgcaccat

SEQ ID NO: 564744 - DNA, 491 bp, Homo sapiens
  misc_feature: HIJSMM301AIP3A.41.2.A02.1.454.light.4.raw
tctatactatcacgaccggtgctcgatttagactcatctacaggggcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttccccg

SEQ ID NO: 564745 - DNA, 488 bp, Homo sapiens
  misc_feature: HIJSMM301DDZUJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 564746 - DNA, 499 bp, Homo sapiens; identical to SEQ ID NO: 558147
  misc_feature: HIJSMM301A5LQK.15.25.C03.1.454.light.4.raw

SEQ ID NO: 564747 - DNA, 484 bp, Homo sapiens
  misc_feature: HIJSMM301EJL4I.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacaggcctccctgaccattactggactccaacctgaggacgaggctgactattattgctcagcatgggacaccagcctcaatgccgcggtattcggcgcagggaccaagctgaccgtcctaggtcacg

SEQ ID NO: 564748 - DNA, 497 bp, Homo sapiens
  misc_feature: HIJSMM301DLS8T.52.37.D04.1.454.light.4.raw
cgcagtacgacacgaccggtgctcgatttagtagcatactgttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 564749 - DNA, 507 bp, Homo sapiens; identical to SEQ ID NO: 563344
  misc_feature: HIJSMM301BCOTE.3.79.H02.1.454.light.4.raw

SEQ ID NO: 564750 - DNA, 511 bp, Homo sapiens
  misc_feature: HIJSMM301DRWZM.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttccca

SEQ ID NO: 564751 - DNA, 441 bp, Homo sapiens; identical to SEQ ID NO: 534971
  misc_feature: HIJSMM301A45OU.11.3.A03.1.454.light.4.raw

SEQ ID NO: 564752 - DNA, 488 bp, Homo sapiens; identical to SEQ ID NO: 535081
  misc_feature: HIJSMM301BCBIJ.26.23.C01.1.454.light.4.raw

SEQ ID NO: 564753 - DNA, 503 bp, Homo sapiens
  misc_feature: HIJSMM301ALWIE.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcaacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 564754 - DNA, 503 bp, Homo sapiens
  misc_feature: HIJSMM301CZNWR.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtctggtcagcccaaggctcgccccctcggtcta

SEQ ID NO: 564755 - DNA, 509 bp, Homo sapiens
  misc_feature: HIJSMM301BBBCI.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgccattcggcggagggaccaagctgaccgtcttaagtcagcccaaggctgccccctcggtcactctgttcccg

SEQ ID NO: 564756 - DNA, 523 bp, Homo sapiens
  misc_feature: HIJSMM301BDQEM.8.87.H10.1.454.light.4.raw
ctcgcgtgtccacgaccggtgctcgatttagcagtactgcgttgggtttggggtcgtgggccgtccaggaagcagcatcgggggtggccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacacg

SEQ ID NO: 564757 - DNA, 494 bp, Homo sapiens
  misc_feature: HIJSMM301C7F2T.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 564758 - DNA, 503 bp, Homo sapiens; identical to SEQ ID NO: 537518
  misc_feature: HIJSMM301BY6HE.8.19.B08.1.454.light.4.raw

SEQ ID NO: 564759 - DNA, 518 bp, Homo sapiens
  misc_feature: HIJSMM301EEKQN.43.45.E01.1.454.light.4.raw
tgtgagtagtcacgaccggtgctcgatttagtgagtcagtaagggaaaggggggcctgaggaagcagcactggtggtgcctcagccatggcctggaccgttctcctcctcggcctcctctctcactgcacaggctccgtgacctcctatgaactgactcagccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgaggccggggacgaggccgactattattgtcaactgtgggatggtactggtgaccggtactgggtgttcggcggagggaccaagctgaccgtctaggtcagcccaaggctgccccctcggtcactctgttcccacctcctcacta

SEQ ID NO: 564760 - DNA, 485 bp, Homo sapiens; identical to SEQ ID NO: 535985
  misc_feature: HIJSMM301BNVGE.15.1.A01.1.454.light.4.raw

SEQ ID NO: 564761 - DNA, 486 bp, Homo sapiens; identical to SEQ ID NO: 551175
  misc_feature: HIJSMM301DHPP8.41.33.C11.1.454.light.4.raw

SEQ ID NO: 564762 - DNA, 519 bp, Homo sapiens; identical to SEQ ID NO: 548902
  misc_feature: HIJSMM301DIF9G.27.23.C01.1.454.light.4.raw

SEQ ID NO: 564763 - DNA, 447 bp, Homo sapiens; identical to SEQ ID NO: 535020
  misc_feature: HIJSMM301EKFT1.18.9.A09.1.454.light.4.raw

SEQ ID NO: 564764 - DNA, 476 bp, Homo sapiens; identical to SEQ ID NO: 549636
  misc_feature: HIJSMM301ECTTD.41.5.A05.1.454.light.4.raw

SEQ ID NO: 564765 - DNA, 493 bp, Homo sapiens; identical to SEQ ID NO: 536007
  misc_feature: HIJSMM301BL789.27.78.H01.1.454.light.4.raw

SEQ ID NO: 564766 - DNA, 491 bp, Homo sapiens
  misc_feature: HIJSMM301B0TFP.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggaggatcaagcgaactgtggctgcaccatctgtctt

SEQ ID NO: 564767 - DNA, 503 bp, Homo sapiens
  misc_feature: HIJSMM301D5089.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccgaaggtggagttcaaacgaactgtggctgcaccatctgtcttcatcttcccg

SEQ ID NO: 564768 - DNA, 481 bp, Homo sapiens
  misc_feature: HIJSMM301C3R4M.43.51.E07.1.454.light.4.raw
tgtgagtagtcacgaccggtgctcgatttagcatactctacaacacacaaaggggacaagaggcagcactcaggacaatctccagcatggcctggtctcctctcctcctcactctcctcgctcactgcacagggtcctgggcccagtctgtattgacgcagccgccctcagtgtctggggccccagggcagagggtcaccatctcctgcactgggagcgcctccaacattgggacaggttatgatgtacactggtaccagcaccttccaggagcagcccccaaatcgtcatctatgctgacaacagtcggccctcaggggtccctgaccgattctctggctccaagtctggcacctcagcctccctggacatcactgggctccaggctgaggatgaggctgactattactgccagtgctatgacagcgacctgagcggttcgatcttcggcggaggacgaagctgaccgtcctaagtcacg

SEQ ID NO: 564769 - DNA, 495 bp, Homo sapiens; identical to SEQ ID NO: 537716
  misc_feature: HIJSMM301D2ZEB.22.14.B03.1.454.light.4.raw

SEQ ID NO: 564770 - DNA, 518 bp, Homo sapiens
  misc_feature: HIJSMM301EP0OQ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggttgtgacgacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtgggcaggtcagccaaggctcgcccctcggtcactctcgttcccgccctcctccacg

SEQ ID NO: 564771 - DNA, 514 bp, Homo sapiens; identical to SEQ ID NO: 540552
  misc_feature: HIJSMM301EA7WA.16.66.F11.1.454.light.4.raw

SEQ ID NO: 564772 - DNA, 491 bp, Homo sapiens
  misc_feature: HIJSMM301DREVU.48.20.B09.1.454.light.4.raw
agtatacatacacgaccggtgctcgatttagtgtagtgtgaagggggggtgagggttgagaacctatgaacattctgtaggggccactgtcttctccacggtgctcccttcatgcgtgacctggcagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggagtaattatgtatcctggttccagcagttcccaggaacagcccccaaactcctcattcatgacactaataagcgaccctcaggcattcctgaccgattctctggctccaagtctggcacgtcagccacctggcatcaccggactccagactggggacgaggccgtaa

SEQ ID NO: 564773 - DNA, 496 bp, Homo sapiens
  misc_feature: HIJSMM301B7O07.15.31.C09.1.454.light.4.raw
tctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtcctaggtcagcccaagg

SEQ ID NO: 564774 - DNA, 444 bp, Homo sapiens; identical to SEQ ID NO: 535027
  misc_feature: HIJSMM301AM5YQ.8.73.G07.1.454.light.4.raw

SEQ ID NO: 564775 - DNA, 447 bp, Homo sapiens; identical to SEQ ID NO: 535020
  misc_feature: HIJSMM301BLRW9.18.9.A09.1.454.light.4.raw

SEQ ID NO: 564776 - DNA, 482 bp, Homo sapiens; identical to SEQ ID NO: 540521
  misc_feature: HIJSMM301DB932.21.25.C03.1.454.light.4.raw

SEQ ID NO: 564777 - DNA, 502 bp, Homo sapiens; identical to SEQ ID NO: 541971
  misc_feature: HIJSMM301CNRBK.4.39.D06.1.454.light.4.raw

SEQ ID NO: 564778 - DNA, 477 bp, Homo sapiens
  misc_feature: HIJSMM301DSVTN.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggac

SEQ ID NO: 564779 - DNA, 511 bp, Homo sapiens
  misc_feature: HIJSMM301EUPCU.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggtccacgggaccgaacggtggaaagtacaaacgaaacctagtggctgcaccaatctgtcttt

SEQ ID NO: 564780 - DNA, 489 bp, Homo sapiens
  misc_feature: HIJSMM301BVKGK.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaaggctggagatcaggcgaacg

SEQ ID NO: 564781 - DNA, 479 bp, Homo sapiens; identical to SEQ ID NO: 535665
  misc_feature: HIJSMM301C61K5.12.10.A10.1.454.light.4.raw

SEQ ID NO: 564782 - DNA, 479 bp, Homo sapiens; identical to SEQ ID NO: 535586
  misc_feature: HIJSMM301B38GS.13.34.D01.1.454.light.4.raw

SEQ ID NO: 564783 - DNA, 488 bp, Homo sapiens; identical to SEQ ID NO: 545530
  misc_feature: HIJSMM301AT4DF.47.38.D05.1.454.light.4.raw

SEQ ID NO: 564784 - DNA, 520 bp, Homo sapiens; identical to SEQ ID NO: 539176
  misc_feature: HIJSMM301D7NY8.27.23.C01.1.454.light.4.raw

SEQ ID NO: 564785 - DNA, 518 bp, Homo sapiens; identical to SEQ ID NO: 539372
  misc_feature: HIJSMM301DG547.7.86.H09.1.454.light.4.raw

SEQ ID NO: 564786 - DNA, 444 bp, Homo sapiens; identical to SEQ ID NO: 535027
  misc_feature: HIJSMM301A5LLP.8.73.G07.1.454.light.4.raw

SEQ ID NO: 564787 - DNA, 502 bp, Homo sapiens
  misc_feature: HIJSMM301CWWT2.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagccaaggctgccccctcggt

SEQ ID NO: 564788 - DNA, 492 bp, Homo sapiens; identical to SEQ ID NO: 535426
  misc_feature: HIJSMM301AM7F4.47.78.H01.1.454.light.4.raw

SEQ ID NO: 564789 - DNA, 489 bp, Homo sapiens
  misc_feature: HIJSMM301BRW5D.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacttttggccaggggaccaagctggagatacaaacgaactgtggctgcaccat

SEQ ID NO: 564790 - DNA, 499 bp, Homo sapiens; identical to SEQ ID NO: 542463
  misc_feature: HIJSMM301BJ9PC.26.26.C04.1.454.light.4.raw

SEQ ID NO: 564791 - DNA, 520 bp, Homo sapiens
  misc_feature: HIJSMM301AO20Y.9.86.H09.1.454.light.4.raw
tgatacgtctcacgaccggtgctcgatttagtgctatagacttgggtttgggggggggtcgacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccgccctcct

SEQ ID NO: 564792 - DNA, 512 bp, Homo sapiens
  misc_feature: HIJSMM301CR0V9.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccgaggctgaccgtcggcggtcgagcccaaggctcgccccctccggtccactctcgttcccgtccctccctt

SEQ ID NO: 564793 - DNA, 502 bp, Homo sapiens
  misc_feature: HIJSMM301D2CXM.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccgaagggaccgagggtggaaagtacaaacgaaactagtggctgcaccatctgtcttctatt

SEQ ID NO: 564794 - DNA, 498 bp, Homo sapiens; identical to SEQ ID NO: 535974
  misc_feature: HIJSMM301ANBU8.22.27.C05.1.454.light.4.raw

SEQ ID NO: 564795 - DNA, 479 bp, Homo sapiens; identical to SEQ ID NO: 535118
  misc_feature: HIJSMM301EHEXD.13.59.F04.1.454.light.4.raw

SEQ ID NO: 564796 - DNA, 463 bp, Homo sapiens
  misc_feature: HIJSMM301EMQB3.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttatactgtcaaaagaatagcgctgccccgctcagtttcggcggagggaccaaggtggagata

SEQ ID NO: 564797 - DNA, 475 bp, Homo sapiens
  misc_feature: HIJSMM301A8LAU.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgaagtgcatatgaagagaactgtggctgca

SEQ ID NO: 564798 - DNA, 465 bp, Homo sapiens
  misc_feature: HIJSMM301DTL24.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcccttgggaccagagtggacaatgaaacgaa

SEQ ID NO: 564799 - DNA, 506 bp, Homo sapiens
  misc_feature: HIJSMM301B5FGF.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggaggaccaaggtgaccgtcctaggtcagcccaaggctcgccccctcggtcactctccg

SEQ ID NO: 564800 - DNA, 497 bp, Homo sapiens; identical to SEQ ID NO: 539058
  misc_feature: HIJSMM301DP3PS.12.87.H10.1.454.light.4.raw

SEQ ID NO: 564801 - DNA, 494 bp, Homo sapiens; identical to SEQ ID NO: 535828
  misc_feature: HIJSMM301ETR7Y.3.36.D03.1.454.light.4.raw

SEQ ID NO: 564802 - DNA, 478 bp, Homo sapiens
  misc_feature: HIJSMM301AH8EP.49.38.D05.1.454.light.4.raw
agtcgagagacacgaccggtgctcgatttagtatctgatagttgggtttggggcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacc

SEQ ID NO: 564803 - DNA, 514 bp, Homo sapiens
  misc_feature: HIJSMM301EB1JJ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcgggcggagggaccaagctgaccgtcctaggtcagcccaaggctgccccctcggtcactctgttcccgccctcctcgctacgtaga

SEQ ID NO: 564804 - DNA, 520 bp, Homo sapiens
  misc_feature: HIJSMM301AH03R.48.23.C01.1.454.light.4.raw
agtatacatacacgaccggtgctcgatttagtacacgtgattagggattggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccgccctcctcta

SEQ ID NO: 564805 - DNA, 499 bp, Homo sapiens
  misc_feature: HIJSMM301BJ3II.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggagggaccgagctgaccgtcctacgtcagcccaaggctccg

SEQ ID NO: 564806 - DNA, 502 bp, Homo sapiens
  misc_feature: HIJSMM301D7TF3.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaacgaactgtggctgcaccatctgtcttcat

SEQ ID NO: 564807 - DNA, 483 bp, Homo sapiens
  misc_feature: HIJSMM301BJ5WL.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtcta

SEQ ID NO: 564808 - DNA, 501 bp, Homo sapiens; identical to SEQ ID NO: 538461
  misc_feature: HIJSMM301AEP6E.13.11.A11.1.454.light.4.raw

SEQ ID NO: 564809 - DNA, 496 bp, Homo sapiens
  misc_feature: HIJSMM301D7M32.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaacgaactgtggctgcaccatctgtcttcatt

SEQ ID NO: 564810 - DNA, 504 bp, Homo sapiens
  misc_feature: HIJSMM301CNSPV.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccacggggaccgaaacgcgtggaggatcaaaacgaaactgtggctgcaccatctgt

SEQ ID NO: 564811 - DNA, 495 bp, Homo sapiens
  misc_feature: HIJSMM301ESZTU.8.81.H04.1.454.light.4.raw
ctcgcgtgtccacgaccggtgctcgatttagtagtgtagattcgcgggggagtcagacccagtcaggacacagcatggacatgagggtccccgcctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggtccgggggaccaagctggagatcaaacgaactgtggctgcaccatctgtcttcta

SEQ ID NO: 564812 - DNA, 493 bp, Homo sapiens
  misc_feature: HIJSMM301BOMSK.10.17.B06.1.454.light.4.raw
catagtagtgcacgaccggtgctcgatttagtcgatagtgaagggggagggaactgctcagttaggacccagacggaaccatggaagccccagcgcagcttctcttcctcctgctactctggctcccagataccactggagaagtagtgatgacgcagtctccggccaccctgtctgtggtctccaggggaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagattttgctagtttattactgtcagcagtatgatacctggcctccgtacacttttggccggggaccaagctggaaatcaagcgaactgtggctgcaccatctgtcttcatt

SEQ ID NO: 564813 - DNA, 488 bp, Homo sapiens; identical to SEQ ID NO: 536851
  misc_feature: HIJSMM301EHDZR.41.2.A02.1.454.light.4.raw

SEQ ID NO: 564814 - DNA, 488 bp, Homo sapiens
  misc_feature: HIJSMM301CUINO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaactgaagattttgcaacttactactgtcaacagagttacagtacccccctcactttcggcggagggaccaaggcggagatcagacgaactgtggctgcaccatctgtcttcta

SEQ ID NO: 564815 - DNA, 487 bp, Homo sapiens
  misc_feature: HIJSMM301CY5FL.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcgggcggagggaccaaactgaccgtcctaggtcagcccaaggctgtccccccg

SEQ ID NO: 564816 - DNA, 498 bp, Homo sapiens
  misc_feature: HIJSMM301AU6CY.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggagatcaaacgaactagtggctgcaccatctgtcttcta

SEQ ID NO: 564817 - DNA, 494 bp, Homo sapiens
  misc_feature: HIJSMM301D77KZ.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctggtcactctgttccca

SEQ ID NO: 564818 - DNA, 500 bp, Homo sapiens
  misc_feature: HIJSMM301DIMSW.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggctggtccaagggaccaaggtaggaaatacaaacgaactagtggctgcacca

SEQ ID NO: 564819 - DNA, 522 bp, Homo sapiens
  misc_feature: HIJSMM301BEF3F.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctggccccctcggtcactctgttcccgccct

SEQ ID NO: 564820 - DNA, 480 bp, Homo sapiens
  misc_feature: HIJSMM301BZN47.48.49.E05.1.454.light.4.raw
agtatacatacacgaccggtgctcgatttagagcgactagcaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggccaaggtggaaatcaaacgaactgtgg

SEQ ID NO: 564821 - DNA, 498 bp, Homo sapiens
  misc_feature: HIJSMM301APIY6.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcggccaaggaccgaaggtggatatcagacgaactagttggctgcg

SEQ ID NO: 564822 - DNA, 478 bp, Homo sapiens; identical to SEQ ID NO: 535129
  misc_feature: HIJSMM301BFZAE.11.11.A11.1.454.light.4.raw

SEQ ID NO: 564823 - DNA, 512 bp, Homo sapiens
  misc_feature: HIJSMM301ASKSS.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtggacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 564824 - DNA, 502 bp, Homo sapiens
  misc_feature: HIJSMM301B2GRI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggccgaagatgtggcagtttattattgtcaacaatattattatacttcgtggtacgttcggtccaagggaccgaaggtggagtatcagacgaactgtggcgtgca

SEQ ID NO: 564825 - DNA, 508 bp, Homo sapiens
  misc_feature: HIJSMM301ESW1M.40.9.A09.1.454.light.4.raw
tctagcgactcacgaccggtgctcgatttagcgagacgcgcaggggacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcgaaacgaactgtggctgcaccatctgtcttcatcttccccg

SEQ ID NO: 564826 - DNA, 488 bp, Homo sapiens
  misc_feature: HIJSMM301BO276.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgcaacttattactgtcaacactttaacaattaccctcataagccgttcggccaagggacccaggtggaaccaagcgaactgt

SEQ ID NO: 564827 - DNA, 466 bp, Homo sapiens
  misc_feature: HIJSMM301C2G8W.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagatacg

SEQ ID NO: 564828 - DNA, 494 bp, Homo sapiens
  misc_feature: HIJSMM301DWOF7.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccccctcctccacgagacgtcgtagcgggcggtcgtcggaacgaaggccgactaagag

SEQ ID NO: 564829 - DNA, 494 bp, Homo sapiens; identical to SEQ ID NO: 536974
  misc_feature: HIJSMM301DU0PV.16.86.H09.1.454.light.4.raw

SEQ ID NO: 564830 - DNA, 496 bp, Homo sapiens
  misc_feature: HIJSMM301CZI2J.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 564831 - DNA, 502 bp, Homo sapiens; identical to SEQ ID NO: 539002
  misc_feature: HIJSMM301CO28S.18.59.F04.1.454.light.4.raw

SEQ ID NO: 564832 - DNA, 471 bp, Homo sapiens
  misc_feature: HIJSMM301AUN5D.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtcctcccgctcactttcggcggagggaccaaggtggagatacaaacgaa

SEQ ID NO: 564833 - DNA, 488 bp, Homo sapiens; identical to SEQ ID NO: 536554
  misc_feature: HIJSMM301ESZKM.26.37.D04.1.454.light.4.raw

SEQ ID NO: 564834 - DNA, 499 bp, Homo sapiens
  misc_feature: HIJSMM301AG0BI.49.9.A09.1.454.light.4.raw
agtcgagagacacgaccggtgctcgatttagcgagacgcgcagggcacgaccggtgctcgatttagtcgatagtgaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgacccg

SEQ ID NO: 564835 - DNA, 494 bp, Homo sapiens; identical to SEQ ID NO: 534992
  misc_feature: HIJSMM301DZVIN.9.1.A01.1.454.light.4.raw

SEQ ID NO: 564836 - DNA, 497 bp, Homo sapiens
  misc_feature: HIJSMM301B0J52.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggagatcaaacgaactgtggctgcaccatctgtt

SEQ ID NO: 564837 - DNA, 447 bp, Homo sapiens; identical to SEQ ID NO: 535201
  misc_feature: HIJSMM301ERNX3.18.9.A09.1.454.light.4.raw

SEQ ID NO: 564838 - DNA, 503 bp, Homo sapiens
  misc_feature: HIJSMM301AR5ZT.48.81.H04.1.454.light.4.raw
agtatacatacacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctcggt

SEQ ID NO: 564839 - DNA, 513 bp, Homo sapiens; identical to SEQ ID NO: 541387
  misc_feature: HIJSMM301CAW9W.17.33.C11.1.454.light.4.raw

SEQ ID NO: 564840 - DNA, 483 bp, Homo sapiens; identical to SEQ ID NO: 535413
  misc_feature: HIJSMM301DE48P.26.78.H01.1.454.light.4.raw

SEQ ID NO: 564841 - DNA, 505 bp, Homo sapiens
  misc_feature: HIJSMM301A1YAZ.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggcccaaccccactgtcactctcgttcccaccctcctcta

SEQ ID NO: 564842 - DNA, 484 bp, Homo sapiens; identical to SEQ ID NO: 535211
  misc_feature: HIJSMM301B8ME1.47.46.E02.1.454.light.4.raw

SEQ ID NO: 564843 - DNA, 349 bp, Homo sapiens; identical to SEQ ID NO: 537129
  misc_feature: HIJSMM301EPVNL.13.11.A11.1.454.light.4.raw

SEQ ID NO: 564844 - DNA, 477 bp, Homo sapiens
  misc_feature: HIJSMM301CB58X.48.30.C08.1.454.light.4.raw
agtatacatacacgaccggtgctcgatttagtctgacgtcaaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcct

SEQ ID NO: 564845 - DNA, 497 bp, Homo sapiens
  misc_feature: HIJSMM301DD0T8.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctgtt

SEQ ID NO: 564846 - DNA, 511 bp, Homo sapiens
  misc_feature: HIJSMM301CZ9L8.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgcccctcggtcactctgtt

SEQ ID NO: 564847 - DNA, 493 bp, Homo sapiens
  misc_feature: HIJSMM301CL7XS.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccgggtccctgagcgattcagtggcagcgggtctgggacagatttcactctcaccatcagcagcctgcaggctgaagatgtggcagtttattactgtcagcaatattctactactcctcggacttcggtcggacgggaccgaaggtaggagagtacaaacgaaact

SEQ ID NO: 564848 - DNA, 506 bp, Homo sapiens
  misc_feature: HIJSMM301DL51Z.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgc

SEQ ID NO: 564849 - DNA, 513 bp, Homo sapiens
  misc_feature: HIJSMM301CWI8M.40.18.B07.1.454.light.4.raw
tctagcgactcacgaccggtgctcgatttagtcgctgcgtaagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaacccactgtcactctgttccccg

SEQ ID NO: 564850 - DNA, 505 bp, Homo sapiens
  misc_feature: HIJSMM301CDCRB.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtcccccacactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttccca

SEQ ID NO: 564851 - DNA, 505 bp, Homo sapiens
  misc_feature: HIJSMM301D5F2R.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcaggcccaaggctgccccctcggtcact

SEQ ID NO: 564852 - DNA, 478 bp, Homo sapiens
  misc_feature: HIJSMM301EIZK1.51.76.G10.1.454.light.4.raw
cgatcgtatacacgaccggtgctcgatttagtcactcatacagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccagggcagtctccacaggtcctgatctatttgagttctaatcgggccccgggtccctgacaggttcagtggcagtggatcaggctgaggatgttggggtttatcattgcatgcaagctctacaaactcctctagactttcggcggagggaccgaacggtggagatcaagcgaactgtggctgcaccatctgtcttcatcttcccgccat

SEQ ID NO: 564853 - DNA, 504 bp, Homo sapiens; identical to SEQ ID NO: 539083
  misc_feature: HIJSMM301BXA4W.8.19.B08.1.454.light.4.raw

SEQ ID NO: 564854 - DNA, 483 bp, Homo sapiens; identical to SEQ ID NO: 545893
  misc_feature: HIJSMM301B61Y8.3.38.D05.1.454.light.4.raw

SEQ ID NO: 564855 - DNA, 498 bp, Homo sapiens
  misc_feature: HIJSMM301AZDM4.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatacaaacgaactagtggctgcaccatctgtcttctatt

SEQ ID NO: 564856 - DNA, 479 bp, Homo sapiens; identical to SEQ ID NO: 537163
  misc_feature: HIJSMM301BAQ48.13.73.G07.1.454.light.4.raw

SEQ ID NO: 564857 - DNA, 504 bp, Homo sapiens
  misc_feature: HIJSMM301EPKXB.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgcccctcggtcta

SEQ ID NO: 564858 - DNA, 487 bp, Homo sapiens
  misc_feature: HIJSMM301AYLK5.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttaattcaaactttcggtccctgggaccaatgtggatatcaaacgaaactagtggcgtgcaccatctgt

SEQ ID NO: 564859 - DNA, 478 bp, Homo sapiens
  misc_feature: HIJSMM301A0QEP.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttggttaaggggaaagtaatgaagttaacactgtggatcaccttcggccaagggacacgactggagattaaacgaactgtggctgcaccatctgtcttcatcttcccgccatctgaagtatagtct

SEQ ID NO: 564860 - DNA, 468 bp, Homo sapiens
  misc_feature: HIJSMM301DLG81.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcaacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggaggaccaaggtggagatcaaacgaa

SEQ ID NO: 564861 - DNA, 509 bp, Homo sapiens
  misc_feature: HIJSMM301BA18S.43.30.C08.1.454.light.4.raw
tgtgagtagtcacgaccggtgctcgatttagtctgacgtcaaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacaatttcgttatactccgccgacgttcggtccgggggaccgaccgtcggaaatactaaacgaactagtggctgcaccatctgtcttctatcttccccg

SEQ ID NO: 564862 - DNA, 484 bp, Homo sapiens; identical to SEQ ID NO: 538247
  misc_feature: HIJSMM301A5221.14.53.E09.1.454.light.4.raw

SEQ ID NO: 564863 - DNA, 489 bp, Homo sapiens
  misc_feature: HIJSMM301AZWL5.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggaggatcaaacgaaa

SEQ ID NO: 564864 - DNA, 485 bp, Homo sapiens
  misc_feature: HIJSMM301DE94M.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgacccatctctggcctccagcctgaggatgaggctgattattactgttgctcatatgcaggcggtaccgcttgggtgttcggcggagggaccaagctgaccgtctaggtcaga

SEQ ID NO: 564865 - DNA, 493 bp, Homo sapiens; identical to SEQ ID NO: 535047
  misc_feature: HIJSMM301D8ZI1.16.53.E09.1.454.light.4.raw

SEQ ID NO: 564866 - DNA, 496 bp, Homo sapiens; identical to SEQ ID NO: 538625
  misc_feature: HIJSMM301CEXGT.2.49.E05.1.454.light.4.raw

SEQ ID NO: 564867 - DNA, 500 bp, Homo sapiens
  misc_feature: HIJSMM301CTCGR.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctcctgggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggc

SEQ ID NO: 564868 - DNA, 479 bp, Homo sapiens; identical to SEQ ID NO: 537141
  misc_feature: HIJSMM301DAH8B.7.76.G10.1.454.light.4.raw

SEQ ID NO: 564869 - DNA, 505 bp, Homo sapiens
  misc_feature: HIJSMM301A7RXI.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtctac

SEQ ID NO: 564870 - DNA, 494 bp, Homo sapiens; identical to SEQ ID NO: 535629
  misc_feature: HIJSMM301CZCQP.4.27.C05.1.454.light.4.raw

SEQ ID NO: 564871 - DNA, 468 bp, Homo sapiens
  misc_feature: HIJSMM301DW5WT.49.82.H05.1.454.light.4.raw
agtcgagagacacgaccggtgctcgatttagtcgagctctctcgcgggcacgaccggtgctcgatttagtatctgatagttgggtttggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaata

SEQ ID NO: 564872 - DNA, 441 bp, Homo sapiens; identical to SEQ ID NO: 535074
  misc_feature: HIJSMM301BX0HS.11.3.A03.1.454.light.4.raw

SEQ ID NO: 564873 - DNA, 484 bp, Homo sapiens; identical to SEQ ID NO: 535240
  misc_feature: HIJSMM301BHSHP.47.60.F05.1.454.light.4.raw

SEQ ID NO: 564874 - DNA, 492 bp, Homo sapiens
  misc_feature: HIJSMM301EIOLD.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagcccaaggccaacccc

SEQ ID NO: 564875 - DNA, 502 bp, Homo sapiens
  misc_feature: HIJSMM301DGIS7.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtca

SEQ ID NO: 564876 - DNA, 500 bp, Homo sapiens
  misc_feature: HIJSMM301BJKPD.41.53.E09.1.454.light.4.raw
tctatactatcacgaccggtgctcgatttagagagagtgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctacgtggtacttcggcggagggaccaagctgaccgtcctaggtcacgcccaaggctgccccctggtccactctgtcccgcctcctcatagtat

SEQ ID NO: 564877 - DNA, 514 bp, Homo sapiens; identical to SEQ ID NO: 546238
  misc_feature: HIJSMM301CN5JO.47.85.H08.1.454.light.4.raw

SEQ ID NO: 564878 - DNA, 520 bp, Homo sapiens; identical to SEQ ID NO: 559635
  misc_feature: HIJSMM301BVMZY.49.26.C04.1.454.light.4.raw

SEQ ID NO: 564879 - DNA, 498 bp, Homo sapiens; identical to SEQ ID NO: 535295
  misc_feature: HIJSMM301D02US.15.25.C03.1.454.light.4.raw

SEQ ID NO: 564880 - DNA, 473 bp, Homo sapiens; identical to SEQ ID NO: 538711
  misc_feature: HIJSMM301AQ537.11.17.B06.1.454.light.4.raw

SEQ ID NO: 564881 - DNA, 475 bp, Homo sapiens
  misc_feature: HIJSMM301A7MZ0.48.37.D04.1.454.light.4.raw
agtatacatacacgaccggtgctcgatttagtagcatactgttgggtttggggagggatacgcgtgacagataagaagggcgtggtgggatcagtcctggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtctta

SEQ ID NO: 564882 - DNA, 501 bp, Homo sapiens
  misc_feature: HIJSMM301CTJ2P.9.12.B01.1.454.light.4.raw
tgatacgtctcacgaccggtgctcgatttagtagtgtagattccgcggggacaacaggcaggcaggggcaacaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtggaaatcaaacgaactgtgctgcaccatctgtcttcatcttcccg

SEQ ID NO: 564883 - DNA, 481 bp, Homo sapiens; identical to SEQ ID NO: 535993
  misc_feature: HIJSMM301CI1TN.21.25.C03.1.454.light.4.raw

SEQ ID NO: 564884 - DNA, 489 bp, Homo sapiens
  misc_feature: HIJSMM301CFBNQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatttatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcat

SEQ ID NO: 564885 - DNA, 422 bp, Homo sapiens; identical to SEQ ID NO: 447881
  misc_feature: HIJSMM301ARHEA.9.34.D01.1.454.light.4.raw

SEQ ID NO: 564886 - DNA, 494 bp, Homo sapiens; identical to SEQ ID NO: 534992
  misc_feature: HIJSMM301DGJ62.9.1.A01.1.454.light.4.raw

SEQ ID NO: 564887 - DNA, 492 bp, Homo sapiens
  misc_feature: HIJSMM301ENSR7.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagttattccttttacttcggccctgggaccaaagtggatatcaaacgaactgtggctgcaccat

SEQ ID NO: 564888 - DNA, 498 bp, Homo sapiens; identical to SEQ ID NO: 550538
  misc_feature: HIJSMM301ARBHW.52.29.C07.1.454.light.4.raw

SEQ ID NO: 564889 - DNA, 486 bp, Homo sapiens; identical to SEQ ID NO: 548936
  misc_feature: HIJSMM301D8XSK.5.55.E11.1.454.light.4.raw

SEQ ID NO: 564890 - DNA, 441 bp, Homo sapiens
  misc_feature: HIJSMM301CNLNO.41.9.A09.1.454.light.4.raw
  modified_base (423)..(423): a, c, t, g, unknown or other
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccnccctcctcatagtataga

SEQ ID NO: 564891 - DNA, 495 bp, Homo sapiens
  misc_feature: HIJSMM301C5TPD.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtct

SEQ ID NO: 564892 - DNA, 508 bp, Homo sapiens
  misc_feature: HIJSMM301DVFKW.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccaaactgaccgtcctaggtcagcccaaggctgccccctcggtcact

SEQ ID NO: 564893 - DNA, 474 bp, Homo sapiens
  misc_feature: HIJSMM301AODKR.41.8.A08.1.454.light.4.raw
tctatactatcacgaccggtgctcgatttagcatactctacagggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgactgtggctgcacc

SEQ ID NO: 564894 - DNA, 496 bp, Homo sapiens; identical to SEQ ID NO: 542319
  misc_feature: HIJSMM301AOBSE.26.72.G06.1.454.light.4.raw

SEQ ID NO: 564895 - DNA, 495 bp, Homo sapiens
  misc_feature: HIJSMM301C4G9S.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacaatcgtcttcggaactgggaccaaaggtcaccgtccg

SEQ ID NO: 564896 - DNA, 478 bp, Homo sapiens
  misc_feature: HIJSMM301A3XIA.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagccctcctggccatcactgggctccaggctgaggatggaggctgattattactgccagtcgtatgacagcagcctgagtgtttgggtgttcggcggaggga

SEQ ID NO: 564897 - DNA, 494 bp, Homo sapiens
  misc_feature: HIJSMM301DIQWD.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccacgggaccacagtggatatcaggcgaactgtggctgcaccatctgtctt

SEQ ID NO: 564898 - DNA, 468 bp, Homo sapiens
  misc_feature: HIJSMM301COCIP.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagataagaaatcaaacgaa

SEQ ID NO: 564899 - DNA, 499 bp, Homo sapiens; identical to SEQ ID NO: 536187
  misc_feature: HIJSMM301A7ERA.11.67.G01.1.454.light.4.raw

SEQ ID NO: 564900 - DNA, 496 bp, Homo sapiens; identical to SEQ ID NO: 535109
  misc_feature: HIJSMM301EP5P3.16.78.H01.1.454.light.4.raw

SEQ ID NO: 564901 - DNA, 487 bp, Homo sapiens; identical to SEQ ID NO: 549649
  misc_feature: HIJSMM301EN4IQ.19.71.G05.1.454.light.4.raw

SEQ ID NO: 564902 - DNA, 507 bp, Homo sapiens
  misc_feature: HIJSMM301AMR8U.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtctaagtcagcccaaggctgccccctcggtcactctgttccca

SEQ ID NO: 564903 - DNA, 486 bp, Homo sapiens; identical to SEQ ID NO: 564416
  misc_feature: HIJSMM301CRHKZ.14.55.E11.1.454.light.4.raw

SEQ ID NO: 564904 - DNA, 501 bp, Homo sapiens
  misc_feature: HIJSMM301B9ZOM.43.87.H10.1.454.light.4.raw
tgtgagtagtcacgaccggtgctcgatttagcagtactgcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccct

SEQ ID NO: 564905 - DNA, 502 bp, Homo sapiens
  misc_feature: HIJSMM301BCT4T.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctc

SEQ ID NO: 564906 - DNA, 470 bp, Homo sapiens; identical to SEQ ID NO: 536130
  misc_feature: HIJSMM301E3U3D.7.81.H04.1.454.light.4.raw

SEQ ID NO: 564907 - DNA, 444 bp, Homo sapiens; identical to SEQ ID NO: 535594
  misc_feature: HIJSMM301DY5DB.9.9.A09.1.454.light.4.raw

SEQ ID NO: 564908 - DNA, 484 bp, Homo sapiens
  misc_feature: HIJSMM301ECQ45.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcggtgttcggcggagggaccaagctgaccgtcctaggtcagcccaaggctgccccctcggtcta

SEQ ID NO: 564909 - DNA, 491 bp, Homo sapiens
  misc_feature: HIJSMM301DX1G1.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtctattactgtcagcagtatggtcacgtacccaagtaacttttggccaggggaccaagctggagatacaaacgaactgtggctgcaccat

SEQ ID NO: 564910 - DNA, 444 bp, Homo sapiens; identical to SEQ ID NO: 535027
  misc_feature: HIJSMM301AHSSE.8.73.G07.1.454.light.4.raw

SEQ ID NO: 564911 - DNA, 503 bp, Homo sapiens; identical to SEQ ID NO: 542253
  misc_feature: HIJSMM301CKZOH.12.53.E09.1.454.light.4.raw

SEQ ID NO: 564912 - DNA, 482 bp, Homo sapiens; identical to SEQ ID NO: 535352
  misc_feature: HIJSMM301D70QP.16.81.H04.1.454.light.4.raw

SEQ ID NO: 564913 - DNA, 479 bp, Homo sapiens; identical to SEQ ID NO: 535188
  misc_feature: HIJSMM301DUL8R.10.74.G08.1.454.light.4.raw

SEQ ID NO: 564914 - DNA, 497 bp, Homo sapiens; identical to SEQ ID NO: 535740
  misc_feature: HIJSMM301B4K82.3.71.G05.1.454.light.4.raw

SEQ ID NO: 564915 - DNA, 507 bp, Homo sapiens; identical to SEQ ID NO: 563344
  misc_feature: HIJSMM301ASJ0P.3.79.H02.1.454.light.4.raw

SEQ ID NO: 564916 - DNA, 471 bp, Homo sapiens; identical to SEQ ID NO: 537461
  misc_feature: HIJSMM301AQAVJ.7.81.H04.1.454.light.4.raw

SEQ ID NO: 564917 - DNA, 445 bp, Homo sapiens; identical to SEQ ID NO: 537719
  misc_feature: HIJSMM301BQWCC.47.85.H08.1.454.light.4.raw

SEQ ID NO: 564918 - DNA, 511 bp, Homo sapiens
  misc_feature: HIJSMM301BR0C9.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctggtcagcccaaggctgccccctcc

SEQ ID NO: 564919 - DNA, 475 bp, Homo sapiens
  misc_feature: HIJSMM301A2NH0.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccgaaggtggaggatcaaacgaa

SEQ ID NO: 564920 - DNA, 508 bp, Homo sapiens
  misc_feature: HIJSMM301DMTHN.14.7.A07.1.454.light.4.raw
  modified_base (433)..(433): a, c, t, g, unknown or other
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattancactgtgcgttgtatatgggttttggcatttcggtgttcggcggagggacccaggtgaccgtcctacgtcagccc

SEQ ID NO: 564921 - DNA, 512 bp, Homo sapiens
  misc_feature: HIJSMM301ALHSN.19.72.G06.1.454.light.4.raw
tactctcgtgcacgaccggtgctcgatttagctacgactgcaaggggaaaggggggggtcggcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaacctcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctcgccccctcggtcact

SEQ ID NO: 564922 - DNA, 507 bp, Homo sapiens
  misc_feature: HIJSMM301AQGRF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaactagtggctgcaccatctgtcttcactcttccccg

SEQ ID NO: 564923 - DNA, 486 bp, Homo sapiens; identical to SEQ ID NO: 537583
  misc_feature: HIJSMM301C8HDM.17.25.C03.1.454.light.4.raw

SEQ ID NO: 564924 - DNA, 497 bp, Homo sapiens; identical to SEQ ID NO: 535286
  misc_feature: HIJSMM301DOVLM.18.59.F04.1.454.light.4.raw

SEQ ID NO: 564925 - DNA, 501 bp, Homo sapiens
  misc_feature: HIJSMM301EO6IP.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggtccgggggaccgaacggtaggaggagtacaagacgaactgtggctgcaccatctgtcttctatcttcccgt

SEQ ID NO: 564926 - DNA, 503 bp, Homo sapiens
  misc_feature: HIJSMM301C2M5X.18.78.H01.1.454.light.4.raw
tacgagtatgcacgaccggtgctcgatttagtgtgagtagtttggggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccactgtca

SEQ ID NO: 564927 - DNA, 496 bp, Homo sapiens
  misc_feature: HIJSMM301DD8DI.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgaggacacgcctggagattaaacgaactgtggctgcacat

SEQ ID NO: 564928 - DNA, 503 bp, Homo sapiens; identical to SEQ ID NO: 539764
  misc_feature: HIJSMM301DG31S.21.22.B11.1.454.light.4.raw

SEQ ID NO: 564929 - DNA, 497 bp, Homo sapiens; identical to SEQ ID NO: 535664
  misc_feature: HIJSMM301EGQ45.22.14.B03.1.454.light.4.raw

SEQ ID NO: 564930 - DNA, 485 bp, Homo sapiens; identical to SEQ ID NO: 535822
  misc_feature: HIJSMM301EOSS6.14.53.E09.1.454.light.4.raw

SEQ ID NO: 564931 - DNA, 516 bp, Homo sapiens
  misc_feature: HIJSMM301CXT5B.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcacgttggaagcagccgatccagcctgcggagcctgtgggcaggtcagcccaaggccaacccactgtcactctcg

SEQ ID NO: 564932 - DNA, 514 bp, Homo sapiens; identical to SEQ ID NO: 540552
  misc_feature: HIJSMM301DSLJF.16.66.F11.1.454.light.4.raw

SEQ ID NO: 564933 - DNA, 486 bp, Homo sapiens; identical to SEQ ID NO: 535043
  misc_feature: HIJSMM301EO1RY.46.35.D02.1.454.light.4.raw

SEQ ID NO: 564934 - DNA, 495 bp, Homo sapiens
  misc_feature: HIJSMM301BKDGK.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgtccccccg

SEQ ID NO: 564935 - DNA, 505 bp, Homo sapiens
  misc_feature: HIJSMM301D22JN.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagtttcctttttgttcttcggaactgggaccgaggtcaccgtcctaggtcagcccaaggccaaccccactgtcta

SEQ ID NO: 564936 - DNA, 507 bp, Homo sapiens
  misc_feature: HIJSMM301D7P35.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccacttcggccctgggaccaaagtggatatcaaacgaactagtggctgcaccatctgtcttcta

SEQ ID NO: 564937 - DNA, 489 bp, Homo sapiens
  misc_feature: HIJSMM301DNVYD.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccgggggagtcggcgacggacgacgtggagatcaacgaactgtggctgcaccatctgtcttcatt

SEQ ID NO: 564938 - DNA, 485 bp, Homo sapiens
  misc_feature: HIJSMM301CZN4N.49.20.B09.1.454.light.4.raw
agtcgagagacacgaccggtgctcgatttagtgtagtgtgaagggcttgatgccttggggtgggaggagagacccctcccctgggatcctgcagctctagtctcccgtggtggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtgg

SEQ ID NO: 564939 - DNA, 495 bp, Homo sapiens
  misc_feature: HIJSMM301B3Z3Y.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggtccaggggaccaagctggagatcaatcgaactgtggcg

SEQ ID NO: 564940 - DNA, 521 bp, Homo sapiens
  misc_feature: HIJSMM301CAYXX.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatacataatactccctaccctttacggttcccgtccggtaccggaaacgtaaggtagtaatactaacgaaaacgtaacgtggtcgtcgtcaccaactactcgttcg

SEQ ID NO: 564941 - DNA, 514 bp, Homo sapiens
  misc_feature: HIJSMM301EOYIT.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 564942 - DNA, 498 bp, Homo sapiens
  misc_feature: HIJSMM301DU8J5.51.6.A06.1.454.light.4.raw
cgatcgtatacacgaccggtgctcgatttagatctactgacagggggggtccgaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctgttccccg

SEQ ID NO: 564943 - DNA, 494 bp, Homo sapiens; identical to SEQ ID NO: 535629
  misc_feature: HIJSMM301EOKE0.4.27.C05.1.454.light.4.raw

SEQ ID NO: 564944 - DNA, 497 bp, Homo sapiens; identical to SEQ ID NO: 535664
  misc_feature: HIJSMM301BPZGT.22.14.B03.1.454.light.4.raw

SEQ ID NO: 564945 - DNA, 504 bp, Homo sapiens
  misc_feature: HIJSMM301EJY29.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcacc

SEQ ID NO: 564946 - DNA, 463 bp, Homo sapiens; identical to SEQ ID NO: 536186
  misc_feature: HIJSMM301DZCVT.51.83.H06.1.454.light.4.raw

SEQ ID NO: 564947 - DNA, 508 bp, Homo sapiens; identical to SEQ ID NO: 535649
  misc_feature: HIJSMM301AVTWP.47.55.E11.1.454.light.4.raw

SEQ ID NO: 564948 - DNA, 507 bp, Homo sapiens
  misc_feature: HIJSMM301ADZZ6.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 564949 - DNA, 509 bp, Homo sapiens
  misc_feature: HIJSMM301BQ2AB.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatcctgtcttcatcttcccgcc

SEQ ID NO: 564950 - DNA, 485 bp, Homo sapiens
  misc_feature: HIJSMM301BYOVK.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctccgcacgtaga

SEQ ID NO: 564951 - DNA, 487 bp, Homo sapiens
  misc_feature: HIJSMM301BRLL3.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgctagtttatttctgtcagcagtttaacacctggcctggtaagttttggccgagggaccaagctggagctacaacgaactgtggctgcaccat

SEQ ID NO: 564952 - DNA, 521 bp, Homo sapiens
  misc_feature: HIJSMM301BM2WO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtcagccaaggctgccccctcggtcactctgttcccgccct

SEQ ID NO: 564953 - DNA, 480 bp, Homo sapiens; identical to SEQ ID NO: 535442
  misc_feature: HIJSMM301BECL1.41.17.B06.1.454.light.4.raw

SEQ ID NO: 564954 - DNA, 507 bp, Homo sapiens; identical to SEQ ID NO: 538702
  misc_feature: HIJSMM301CJS5I.11.57.F02.1.454.light.4.raw

SEQ ID NO: 564955 - DNA, 447 bp, Homo sapiens; identical to SEQ ID NO: 535201
  misc_feature: HIJSMM301B09IM.18.9.A09.1.454.light.4.raw

SEQ ID NO: 564956 - DNA, 481 bp, Homo sapiens
  misc_feature: HIJSMM301ARCXX.49.60.F05.1.454.light.4.raw
agtcgagagacacgaccggtgctcgatttagtacgtcatcagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgttacatttttggccaggggaccaagttggagatcaaacgaactgtggctgcacc

SEQ ID NO: 564957 - DNA, 509 bp, Homo sapiens
  misc_feature: HIJSMM301CWI83.43.23.C01.1.454.light.4.raw
tgtgagtagtcacgaccggtgctcgatttagtacacgtgattagggattgggaacctatgaacattctgtaggggccactgtcttctccacggtgctcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactatactgcttgctcgcctatgatgctgctcgggttttcgcggagggaccaagttgaccgtcctaggtcagcccaa

SEQ ID NO: 564958 - DNA, 505 bp, Homo sapiens
  misc_feature: HIJSMM301AU5ON.8.28.C06.1.454.light.4.raw
  modified_base (495)..(495): a, c, t, g, unknown or other
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttacntcttcccgcc

SEQ ID NO: 564959 - DNA, 502 bp, Homo sapiens
  misc_feature: HIJSMM301DF5P5.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccc

SEQ ID NO: 564960 - DNA, 481 bp, Homo sapiens; identical to SEQ ID NO: 535993
  misc_feature: HIJSMM301BGJFB.21.25.C03.1.454.light.4.raw

SEQ ID NO: 564961 - DNA, 500 bp, Homo sapiens; identical to SEQ ID NO: 546613
  misc_feature: HIJSMM301A0NIS.11.21.B10.1.454.light.4.raw

SEQ ID NO: 564962 - DNA, 504 bp, Homo sapiens; identical to SEQ ID NO: 545953
  misc_feature: HIJSMM301DADD1.8.28.C06.1.454.light.4.raw

SEQ ID NO: 564963 - DNA, 521 bp, Homo sapiens
  misc_feature: HIJSMM301C6GMH.27.23.C01.1.454.light.4.raw
  modified_base (391)..(391): a, c, t, g, unknown or other
  modified_base (441)..(441): a, c, t, g, unknown or other
  modified_base (509)..(509): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctctgggctccngcctgaggacgaggctgattattattgtagttcatatacaaccagtgacncttgggtgttcggcggagggaccaggctgaccgtcctacgggtcagcccaaggctgccccctcggtcnctctcgttccct

SEQ ID NO: 564964 - DNA, 494 bp, Homo sapiens; identical to SEQ ID NO: 534992
  misc_feature: HIJSMM301ESBBM.9.1.A01.1.454.light.4.raw

SEQ ID NO: 564965 - DNA, 501 bp, Homo sapiens
  misc_feature: HIJSMM301B0QS1.9.53.E09.1.454.light.4.raw
tgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccaccctcctcagacgtatca

SEQ ID NO: 564966 - DNA, 508 bp, Homo sapiens
  misc_feature: HIJSMM301BX0BD.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtctacc

SEQ ID NO: 564967 - DNA, 509 bp, Homo sapiens
  misc_feature: HIJSMM301BW6E7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagacgatcattggagaagtggtgatgacacagtctccggtcaccctgtctgtttttcctggggagagagccaccctctcctgtgcggccagtcacgagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctagtcagcagtctgaagactggccgttcactttcggcggagggaccaacggtcggacctcaaacgaactgtggctgcaccatctgtcttcatcttccgcc

SEQ ID NO: 564968 - DNA, 501 bp, Homo sapiens
  misc_feature: HIJSMM301B1B7W.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccta

SEQ ID NO: 564969 - DNA, 481 bp, Homo sapiens
  misc_feature: HIJSMM301CEL2D.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagcccccaaacctcctcatttatgatgcctccactttgaatggagggtcccaccaacattcagcggcagtggatctgggacagagttcactctaaccatcagcagcctgcagcctgatgatcttggaacttattctgccagcaatataatagttattggacgtttcggccaggggaccaaggtcgaaatgagacgaactgtggctgcaccatctgt

SEQ ID NO: 564970 - DNA, 496 bp, Homo sapiens; identical to SEQ ID NO: 550328
  misc_feature: HIJSMM301BQXPT.51.5.A05.1.454.light.4.raw

SEQ ID NO: 564971 - DNA, 491 bp, Homo sapiens
  misc_feature: HIJSMM301EFX0V.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtccctcttttagtcatgtatcgggatagaaagcggccctcagggatccctgagcgcttctctggatccaactctgggaacacagccactctgaccatcagcgggacccaacttttagatgaggccgactattctgtcacacgtgggacatgggcactgcgatcttcggcggagggaccaagctgaccgtcctgggtcagcccaaggctgcccctcggtcact

SEQ ID NO: 564972 - DNA, 490 bp, Homo sapiens
  misc_feature: HIJSMM301EYPDB.48.38.D05.1.454.light.4.raw
agtatacatacacgaccggtgctcgatttagtatctgatagttgggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 564973 - DNA, 492 bp, Homo sapiens
  misc_feature: HIJSMM301AUI3Z.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactacgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgttttgggtgtttggcggagggaccaagctgaccgtcctaggtcacg

SEQ ID NO: 564974 - DNA, 508 bp, Homo sapiens; identical to SEQ ID NO: 535835
  misc_feature: HIJSMM301CZ7BB.8.34.D01.1.454.light.4.raw

SEQ ID NO: 564975 - DNA, 507 bp, Homo sapiens; identical to SEQ ID NO: 552061
  misc_feature: HIJSMM301BRLNL.47.55.E11.1.454.light.4.raw

SEQ ID NO: 564976 - DNA, 510 bp, Homo sapiens
  misc_feature: HIJSMM301A4HLJ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctaggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacgtaggaagtacaagacgaacctagtggcgtgcgaccaactctgtcttctactcttcccgt

SEQ ID NO: 564977 - DNA, 481 bp, Homo sapiens
  misc_feature: HIJSMM301D2ZHO.48.19.B08.1.454.light.4.raw
  modified_base (444)..(444): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtnttcggcggagggaccaagctgaccgtcctaggtcacg

SEQ ID NO: 564978 - DNA, 498 bp, Homo sapiens
  misc_feature: HIJSMM301BJCBW.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatacgaaacgaacgtgtggctgacaccatctgtcttcactt

SEQ ID NO: 564979 - DNA, 521 bp, Homo sapiens; identical to SEQ ID NO: 538715
  misc_feature: HIJSMM301B7HED.27.23.C01.1.454.light.4.raw

SEQ ID NO: 564980 - DNA, 488 bp, Homo sapiens
  misc_feature: HIJSMM301EJB3I.22.65.F10.1.454.light.4.raw
  modified_base (417)..(417): a, c, t, g, unknown or other
  modified_base (482)..(482): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaatgttcagtggcagtggatctgggacagatttcactctcaccatccgcggtctgcaacctgaagatttcgcaacttactactgtcaacagacttacagtncccccccgatcaccttcggccaagggacacgactggagattaaacgaactgtggctgcaccatcngtcttc

SEQ ID NO: 564981 - DNA, 494 bp, Homo sapiens; identical to SEQ ID NO: 535828
  misc_feature: HIJSMM301DGJUI.3.36.D03.1.454.light.4.raw

SEQ ID NO: 564982 - DNA, 496 bp, Homo sapiens
  misc_feature: HIJSMM301B82YM.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctggtcactctcg

SEQ ID NO: 564983 - DNA, 491 bp, Homo sapiens
  misc_feature: HIJSMM301DHDYQ.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttacgtactgcatgcaagctctacaagccacctacacttttggccaggggacccaggctggagatcaaacgaactgtgg

SEQ ID NO: 564984 - DNA, 492 bp, Homo sapiens; identical to SEQ ID NO: 535126
  misc_feature: HIJSMM301DCGRV.18.11.A11.1.454.light.4.raw

SEQ ID NO: 564985 - DNA, 497 bp, Homo sapiens
  misc_feature: HIJSMM301AFOKG.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgccatctgactact

SEQ ID NO: 564986 - DNA, 393 bp, Homo sapiens
  misc_feature: HIJSMM301DVQD0.52.4.A04.1.454.light.4.raw
cgcagtacgacacgaccggtgctcgatttagagtagtgatcagggagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgccccctggtcactctgttcccaccctcctctatacgatcg

SEQ ID NO: 564987 - DNA, 521 bp, Homo sapiens; identical to SEQ ID NO: 539470
  misc_feature: HIJSMM301BPXIY.27.23.C01.1.454.light.4.raw

SEQ ID NO: 564988 - DNA, 494 bp, Homo sapiens
  misc_feature: HIJSMM301BMKK0.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtggacgatcaagcgaactgtggctgcaccatctgtt

SEQ ID NO: 564989 - DNA, 511 bp, Homo sapiens
  misc_feature: HIJSMM301DX6Q8.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcatt

SEQ ID NO: 564990 - DNA, 495 bp, Homo sapiens; identical to SEQ ID NO: 538651
  misc_feature: HIJSMM301AF341.10.79.H02.1.454.light.4.raw

SEQ ID NO: 564991 - DNA, 490 bp, Homo sapiens; identical to SEQ ID NO: 535936
  misc_feature: HIJSMM301A57HH.16.68.G02.1.454.light.4.raw

SEQ ID NO: 564992 - DNA, 501 bp, Homo sapiens; identical to SEQ ID NO: 536142
  misc_feature: HIJSMM301C09I8.15.1.A01.1.454.light.4.raw

SEQ ID NO: 564993 - DNA, 497 bp, Homo sapiens
  misc_feature: HIJSMM301EAC5O.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggaggaccaaggtggagatcaaacgaactgtggctgcaccatctgtcttcatcttcccgccatctgacta

SEQ ID NO: 564994 - DNA, 486 bp, Homo sapiens; identical to SEQ ID NO: 540626
  misc_feature: HIJSMM301EXG2V.8.12.B01.1.454.light.4.raw

SEQ ID NO: 564995 - DNA, 497 bp, Homo sapiens
  misc_feature: HIJSMM301BZ74G.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactgaccgtcctaggtcagcccaaggctgccccctcggtcactctgttcccc

SEQ ID NO: 564996 - DNA, 488 bp, Homo sapiens; identical to SEQ ID NO: 535990
  misc_feature: HIJSMM301EVT4V.11.28.C06.1.454.light.4.raw

SEQ ID NO: 564997 - DNA, 502 bp, Homo sapiens
  misc_feature: HIJSMM301B2QI6.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgcccccc

SEQ ID NO: 564998 - DNA, 494 bp, Homo sapiens; identical to SEQ ID NO: 534992
  misc_feature: HIJSMM301CG5R2.9.1.A01.1.454.light.4.raw

SEQ ID NO: 564999 - DNA, 493 bp, Homo sapiens
  misc_feature: HIJSMM301AQQST.51.83.H06.1.454.light.4.raw
cgatcgtatacacgaccggtgctcgatttagatcacgtgcgtcgcggggtgggggcacttctccctctaacactctccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaaactgtggctgcaccatctgtcttcatcttccgccat

SEQ ID NO: 565000 - DNA, 446 bp, Homo sapiens; identical to SEQ ID NO: 539491
  misc_feature: HIJSMM301DW6S1.18.9.A09.1.454.light.4.raw

SEQ ID NO: 565001 - DNA, 510 bp, Homo sapiens; identical to SEQ ID NO: 542037
  misc_feature: HIJSMM301A436P.4.57.F02.1.454.light.4.raw

SEQ ID NO: 565002 - DNA, 454 bp, Homo sapiens; identical to SEQ ID NO: 536347
  misc_feature: HIJSMM301DIW4U.19.86.H09.1.454.light.4.raw

SEQ ID NO: 565003 - DNA, 416 bp, Homo sapiens; identical to SEQ ID NO: 539343
  misc_feature: HIJSMM301ALN7K.18.78.H01.1.454.light.4.raw

SEQ ID NO: 565004 - DNA, 499 bp, Homo sapiens
  misc_feature: HIJSMM301CFJPO.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtca

SEQ ID NO: 565005 - DNA, 515 bp, Homo sapiens
  misc_feature: HIJSMM301ASJ4R.48.70.G04.1.454.light.4.raw
agtatacatacacgaccggtgctcgatttagtgtagtgtgaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcct

SEQ ID NO: 565006 - DNA, 444 bp, Homo sapiens
  misc_feature: HIJSMM301A48V7.11.3.A03.1.454.light.4.raw
cgagagataccacgaccggtgctcgatttagagagcgtcacaggggtccgtgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatactatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctctcgtatctctcg

SEQ ID NO: 565007 - DNA, 485 bp, Homo sapiens; identical to SEQ ID NO: 539315
  misc_feature: HIJSMM301CBICQ.3.88.H11.1.454.light.4.raw

SEQ ID NO: 565008 - DNA, 479 bp, Homo sapiens; identical to SEQ ID NO: 538734
  misc_feature: HIJSMM301BBAOQ.8.53.E09.1.454.light.4.raw

SEQ ID NO: 565009 - DNA, 486 bp, Homo sapiens; identical to SEQ ID NO: 535043
  misc_feature: HIJSMM301DO644.46.35.D02.1.454.light.4.raw

SEQ ID NO: 565010 - DNA, 504 bp, Homo sapiens; identical to SEQ ID NO: 535077
  misc_feature: HIJSMM301BH5WY.8.28.C06.1.454.light.4.raw

SEQ ID NO: 565011 - DNA, 441 bp, Homo sapiens; identical to SEQ ID NO: 534971
  misc_feature: HIJSMM301B0VJX.11.3.A03.1.454.light.4.raw

SEQ ID NO: 565012 - DNA, 489 bp, Homo sapiens; identical to SEQ ID NO: 541702
  misc_feature: HIJSMM301CQ0EB.10.72.G06.1.454.light.4.raw

SEQ ID NO: 565013 - DNA, 516 bp, Homo sapiens
  misc_feature: HIJSMM301BQLEM.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagccccaaggccaaccccactgtcactctgttccccgccctcctcga

SEQ ID NO: 565014 - DNA, 490 bp, Homo sapiens; identical to SEQ ID NO: 541141
  misc_feature: HIJSMM301EGEHW.47.38.D05.1.454.light.4.raw

SEQ ID NO: 565015 - DNA, 486 bp, Homo sapiens
  misc_feature: HIJSMM301C6YAR.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaagatcaaacgaa

SEQ ID NO: 565016 - DNA, 447 bp, Homo sapiens; identical to SEQ ID NO: 535882
  misc_feature: HIJSMM301A5O51.18.9.A09.1.454.light.4.raw
  modified_base (429)..(429): a, c, t, g, unknown or other

SEQ ID NO: 565017 - DNA, 493 bp, Homo sapiens
  misc_feature: HIJSMM301DPLEU.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttggccaggggacacgactggagattaagcgaactgtggctgcaccatctgtctt

SEQ ID NO: 565018 - DNA, 495 bp, Homo sapiens; identical to SEQ ID NO: 535596
  misc_feature: HIJSMM301D506F.10.79.H02.1.454.light.4.raw

SEQ ID NO: 565019 - DNA, 510 bp, Homo sapiens
  misc_feature: HIJSMM301C5PWW.5.58.F03.1.454.light.4.raw
atcagacacgcacgaccggtgctcgatttagtctgatcgagaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 565020 - DNA, 486 bp, Homo sapiens
  misc_feature: HIJSMM301BWFON.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttatactgtcagcaatattctactactcctcggactttcggcggagggaccgaaggtggagatcaaacgaa

SEQ ID NO: 565021 - DNA, 495 bp, Homo sapiens; identical to SEQ ID NO: 536055
  misc_feature: HIJSMM301CVF3Z.47.38.D05.1.454.light.4.raw

SEQ ID NO: 565022 - DNA, 492 bp, Homo sapiens; identical to SEQ ID NO: 538317
  misc_feature: HIJSMM301DJNYK.10.17.B06.1.454.light.4.raw

SEQ ID NO: 565023 - DNA, 485 bp, Homo sapiens; identical to SEQ ID NO: 535501
  misc_feature: HIJSMM301ASM8V.3.10.A10.1.454.light.4.raw

SEQ ID NO: 565024 - DNA, 509 bp, Homo sapiens; identical to SEQ ID NO: 541829
  misc_feature: HIJSMM301DZABO.17.28.C06.1.454.light.4.raw

SEQ ID NO: 565025 - DNA, 473 bp, Homo sapiens
  misc_feature: HIJSMM301B58DL.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaacggacacgactggagattaaacgaa

SEQ ID NO: 565026 - DNA, 507 bp, Homo sapiens
  misc_feature: HIJSMM301DVRE7.13.36.D03.1.454.light.4.raw
tcacgtactacacgaccggtgctcgatttagctgcgtcacgatctctcttggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtcttggtcagcccaaggccaaccccactgtca

SEQ ID NO: 565027 - DNA, 496 bp, Homo sapiens; identical to SEQ ID NO: 541772
  misc_feature: HIJSMM301A92GS.51.81.H04.1.454.light.4.raw

SEQ ID NO: 565028 - DNA, 484 bp, Homo sapiens
  misc_feature: HIJSMM301DZ6OQ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaacagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccacctcctcgctacgtaga

SEQ ID NO: 565029 - DNA, 490 bp, Homo sapiens
  misc_feature: HIJSMM301C1SO5.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcacttcggccaagggacacgactggagattaaacgaactgtggctgcaccatct

SEQ ID NO: 565030 - DNA, 479 bp, Homo sapiens
  misc_feature: HIJSMM301BSQJA.48.38.D05.1.454.light.4.raw
agtatacatacacgaccggtgctcgatttagtatctgatagttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccccg

SEQ ID NO: 565031 - DNA, 474 bp, Homo sapiens
  misc_feature: HIJSMM301CRGI1.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctccgatcaccttcggccaagggacacgactggagattaaacgaactgtggctgcacc

SEQ ID NO: 565032 - DNA, 494 bp, Homo sapiens; identical to SEQ ID NO: 557967
  misc_feature: HIJSMM301EFEVW.11.81.H04.1.454.light.4.raw

SEQ ID NO: 565033 - DNA, 500 bp, Homo sapiens
  misc_feature: HIJSMM301AZTN5.14.36.D03.1.454.light.4.raw
cgtctagtaccacgaccggtgctcgatttagctgcgtcacgatctctcttggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccgaaggtgaccgtcctaggtcagcccaaggcg

SEQ ID NO: 565034 - DNA, 500 bp, Homo sapiens
  misc_feature: HIJSMM301B4GS5.16.78.H01.1.454.light.4.raw
tgtactactccacgaccggtgctcgatttagtgtgagtagtttgggtttgggggaggaactgcgtcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggccttccacggtacacttttcggccaggggaccaagctggagatcaaacgaactgtggctgcaccatctgtt

SEQ ID NO: 565035 - DNA, 500 bp, Homo sapiens
  misc_feature: HIJSMM301BUGIE.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctgccccctcggtcactctcg

SEQ ID NO: 565036 - DNA, 428 bp, Homo sapiens
  misc_feature: HIJSMM301A3WMD.49.34.D01.1.454.light.4.raw
agtcgagagacacgaccggtgctcgatttagatcgtctgtgttgggtttgggtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 565037 - DNA, 506 bp, Homo sapiens; identical to SEQ ID NO: 540259
  misc_feature: HIJSMM301EBPOD.15.5.A05.1.454.light.4.raw

SEQ ID NO: 565038 - DNA, 486 bp, Homo sapiens; identical to SEQ ID NO: 535917
  misc_feature: HIJSMM301BQEE4.3.10.A10.1.454.light.4.raw

SEQ ID NO: 565039 - DNA, 514 bp, Homo sapiens
  misc_feature: HIJSMM301BRFQW.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccaccctcct

SEQ ID NO: 565040 - DNA, 502 bp, Homo sapiens
  misc_feature: HIJSMM301AKAT9.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtcctccaccgtccctgtctgctatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgtattttgcgacttactactgtcaacagagtttccggaaccccgttactttcggcggagggaccaaggtggagatcaaacgaactgtggctgcaccatctgtcttcatcttccccg

SEQ ID NO: 565041 - DNA, 447 bp, Homo sapiens; identical to SEQ ID NO: 535020
  misc_feature: HIJSMM301DUE5B.18.9.A09.1.454.light.4.raw

SEQ ID NO: 565042 - DNA, 491 bp, Homo sapiens; identical to SEQ ID NO: 535194
  misc_feature: HIJSMM301BB5BK.26.78.H01.1.454.light.4.raw

SEQ ID NO: 565043 - DNA, 511 bp, Homo sapiens
  misc_feature: HIJSMM301CQ6GV.4.57.F02.1.454.light.4.raw
agcactgtagcacgaccggtgctcgatttagctcgatataggttgggtttgggggcctaaggaagcagcactggtggtgcctcagccatggcctggaccgttctcctcctcggcctcctctctcactgcacaggctctgtgacctcatatgtcgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccgt

SEQ ID NO: 565044 - DNA, 484 bp, Homo sapiens; identical to SEQ ID NO: 535240
  misc_feature: HIJSMM301A308Y.47.60.F05.1.454.light.4.raw

SEQ ID NO: 565045 - DNA, 481 bp, Homo sapiens; identical to SEQ ID NO: 544259
  misc_feature: HIJSMM301EMLO9.3.38.D05.1.454.light.4.raw

SEQ ID NO: 565046 - DNA, 498 bp, Homo sapiens
  misc_feature: HIJSMM301EPNNM.3.10.A10.1.454.light.4.raw
agacgcactccacgaccggtgctcgatttagcgtcgatctcaggggagagctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgctaatttatttctgtcagcagtacaataattggcctttgacgttcggccaagggaccaaggtggaaactaaacgaactgtggctgcaccatctgtctt

SEQ ID NO: 565047 - DNA, 509 bp, Homo sapiens
  misc_feature: HIJSMM301CYX5W.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggaggatcaaacgaaactgtggctgcaccatctgtt

SEQ ID NO: 565048 - DNA, 496 bp, Homo sapiens
  misc_feature: HIJSMM301CJPTR.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaaactgtggctgcaccatctgtcttcatt

SEQ ID NO: 565049 - DNA, 509 bp, Homo sapiens; identical to SEQ ID NO: 536339
  misc_feature: HIJSMM301EMDFS.17.33.C11.1.454.light.4.raw

SEQ ID NO: 565050 - DNA, 493 bp, Homo sapiens; identical to SEQ ID NO: 561962
  misc_feature: HIJSMM301BYK39.41.2.A02.1.454.light.4.raw

SEQ ID NO: 565051 - DNA, 499 bp, Homo sapiens
  misc_feature: HIJSMM301AMFHI.40.52.E08.1.454.light.4.raw
tctagcgactcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctcg

SEQ ID NO: 565052 - DNA, 511 bp, Homo sapiens
  misc_feature: HIJSMM301BLVWE.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggcccgtccgggtcccgtcgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 565053 - DNA, 445 bp, Homo sapiens; identical to SEQ ID NO: 537719
  misc_feature: HIJSMM301C068T.47.85.H08.1.454.light.4.raw

SEQ ID NO: 565054 - DNA, 494 bp, Homo sapiens; identical to SEQ ID NO: 536974
  misc_feature: HIJSMM301A2V7X.16.86.H09.1.454.light.4.raw

SEQ ID NO: 565055 - DNA, 512 bp, Homo sapiens
  misc_feature: HIJSMM301CAPXF.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcgccctgggaccaaggtggaggatacaaacgaactagtggctgcaccactctcgtcttcta

SEQ ID NO: 565056 - DNA, 495 bp, Homo sapiens
  misc_feature: HIJSMM301AP56E.27.78.H01.1.454.light.4.raw
  modified_base (461)..(461): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggacacatttcaccctcaccatcaatagcctggaagctgaagatgctgcaacttattactgtcatcagagtactactttacctcaatgatcaccttcggccaagggacacgactggngattaaacgaactagtggctgcaccatctgtctt

SEQ ID NO: 565057 - DNA, 473 bp, Homo sapiens
  misc_feature: HIJSMM301AHUCG.18.76.G10.1.454.light.4.raw
tacgagtatgcacgaccggtgctcgatttagtcactcatacagggggcaggagtcagtcccaaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 565058 - DNA, 510 bp, Homo sapiens
  misc_feature: HIJSMM301DNUME.51.35.D02.1.454.light.4.raw
cgatcgtatacacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaaactgaccgtcctaggtcagcccaaggctgccccctcggtca

SEQ ID NO: 565059 - DNA, 514 bp, Homo sapiens; identical to SEQ ID NO: 563380
  misc_feature: HIJSMM301AGJV3.22.30.C08.1.454.light.4.raw

SEQ ID NO: 565060 - DNA, 521 bp, Homo sapiens
  misc_feature: HIJSMM301E0CKA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggaccgaacggtaggaagtacgaaacgaaactacgtaggcgtgcgaccactctcgtcttctactcttcccgtcccact

SEQ ID NO: 565061 - DNA, 554 bp, Homo sapiens
  misc_feature: HIJSMM301BUNE0.15.78.H01.1.454.light.4.raw
  modified_base (506)..(506): a, c, t, g, unknown or other
tctacgtagccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtncatggtttagcccccgtttcactcttcccgccatctgagctacgtaga

SEQ ID NO: 565062 - DNA, 491 bp, Homo sapiens; identical to SEQ ID NO: 550951
  misc_feature: HIJSMM301C8ZLD.17.21.B10.1.454.light.4.raw

SEQ ID NO: 565063 - DNA, 501 bp, Homo sapiens
  misc_feature: HIJSMM301B48IE.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattctggggcagcgggtctgggacagatttcactctcaccatcagcagcctgcaggctgaagatgtggcagtttatactgtcagcaatatttttcttatcctccgtggacgttcggccaagggaccagggtggaaatcagacgaactgtggctgcaccatctgt

SEQ ID NO: 565064 - DNA, 495 bp, Homo sapiens; identical to SEQ ID NO: 536055
  misc_feature: HIJSMM301CV9BN.47.38.D05.1.454.light.4.raw

SEQ ID NO: 565065 - DNA, 507 bp, Homo sapiens
  misc_feature: HIJSMM301BXWJY.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggtcggagggaccgaaggtagaggatcaaaggaactagtggctgcacccatctgtcttctatcttcccgtcca

SEQ ID NO: 565066 - DNA, 503 bp, Homo sapiens
  misc_feature: HIJSMM301AJYDA.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtataatgactggtggacgttcggccaagggaccaaggtggagaccaaacgaactgtggctgcaccatctgtcttcatcttcccgccta

SEQ ID NO: 565067 - DNA, 491 bp, Homo sapiens
  misc_feature: HIJSMM301EOWS7.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggccttccgacgttcggccaagggaccaaggtggaaatcaaacgaactagtggctgcgaccat

SEQ ID NO: 565068 - DNA, 486 bp, Homo sapiens
  misc_feature: HIJSMM301BB1WM.8.74.G08.1.454.light.4.raw
ctcgcgtgtccacgaccggtgctcgatttagtagctctatcaggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcacctgcactggatccagcggagacattgggagttatgatgttgtctcttggtatcagcatcacccaggcacagccaccaaattcataatttatcaggtcacgcagcggcccttaggggtttctgatcgcttctctggctccaagtctggcaacacggcctccctgacaatctctgggctccagcctgaggacgaggctgattattactgctgctcatatggtggttctaacactccctatgtcttcggaggtgggaccaaggtcaccgtcctgcgtcagcccaac

SEQ ID NO: 565069 - DNA, 492 bp, Homo sapiens; identical to SEQ ID NO: 540428
  misc_feature: HIJSMM301EH69T.51.81.H04.1.454.light.4.raw

SEQ ID NO: 565070 - DNA, 487 bp, Homo sapiens; identical to SEQ ID NO: 537573
  misc_feature: HIJSMM301ASJA0.3.10.A10.1.454.light.4.raw

SEQ ID NO: 565071 - DNA, 483 bp, Homo sapiens
  misc_feature: HIJSMM301DGMAJ.41.57.F02.1.454.light.4.raw
tctatactatcacgaccggtgctcgatttagctcgatataggttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccacctcccaaattgctatcatacaggaagaacaaccgccctcggggatctccgagagattctctgcatcaacgtcaggaacatagcctccctgaccattacctggactccagcctgaggacgaggctgactattactgctcagcatggacagcagcctcaatgttggtgttcggcggagggaccaagctgaccgtcctaggtcacg

SEQ ID NO: 565072 - DNA, 490 bp, Homo sapiens
  misc_feature: HIJSMM301C5EVI.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaaggaccgaaggtggaagtcaacgaactgtggctgcaccatctgtctt

SEQ ID NO: 565073 - DNA, 474 bp, Homo sapiens
  misc_feature: HIJSMM301D3DMT.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatccactttcggcctggactgaagtgcatatgaagagaactgtggctgca

SEQ ID NO: 565074 - DNA, 507 bp, Homo sapiens
  misc_feature: HIJSMM301AET0H.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggtccgaacgggaccgaacggtagggaaagtacagacgaacgtacgtggctgcaccactactgtctttccta

SEQ ID NO: 565075 - DNA, 498 bp, Homo sapiens
  misc_feature: HIJSMM301B7WND.53.30.C08.1.454.light.4.raw
cgcgtatacacacgaccggtgctcgatttagtctgacgtcaaagggaaaggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgtt

SEQ ID NO: 565076 - DNA, 483 bp, Homo sapiens
  misc_feature: HIJSMM301A6FDB.13.53.E09.1.454.light.4.raw
  modified_base (475)..(475): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggntgcaccat

SEQ ID NO: 565077 - DNA, 482 bp, Homo sapiens; identical to SEQ ID NO: 537205
  misc_feature: HIJSMM301ARYQB.5.39.D06.1.454.light.4.raw

SEQ ID NO: 565078 - DNA, 516 bp, Homo sapiens; identical to SEQ ID NO: 535549
  misc_feature: HIJSMM301B87IQ.14.70.G04.1.454.light.4.raw

SEQ ID NO: 565079 - DNA, 486 bp, Homo sapiens; identical to SEQ ID NO: 535043
  misc_feature: HIJSMM301DIM2G.46.35.D02.1.454.light.4.raw

SEQ ID NO: 565080 - DNA, 361 bp, Homo sapiens; identical to SEQ ID NO: 544890
  misc_feature: HIJSMM301BXOQH.3.57.F02.1.454.light.4.raw

SEQ ID NO: 565081 - DNA, 508 bp, Homo sapiens
  misc_feature: HIJSMM301ECWH2.12.28.C06.1.454.light.4.raw
  modified_base (441)..(441): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcncgggacgacacgtagaatagagacgaacgtagtggcgtgcgaccactctcgtcttctatcttcccgt

SEQ ID NO: 565082 - DNA, 489 bp, Homo sapiens; identical to SEQ ID NO: 535139
  misc_feature: HIJSMM301BBG5N.14.55.E11.1.454.light.4.raw

SEQ ID NO: 565083 - DNA, 447 bp, Homo sapiens; identical to SEQ ID NO: 535201
  misc_feature: HIJSMM301AGQRG.18.9.A09.1.454.light.4.raw

SEQ ID NO: 565084 - DNA, 492 bp, Homo sapiens; identical to SEQ ID NO: 534967
  misc_feature: HIJSMM301EZK3F.47.64.F09.1.454.light.4.raw

SEQ ID NO: 565085 - DNA, 498 bp, Homo sapiens; identical to SEQ ID NO: 540849
  misc_feature: HIJSMM301B74TK.49.62.F07.1.454.light.4.raw

SEQ ID NO: 565086 - DNA, 536 bp, Homo sapiens
  misc_feature: HIJSMM301DI9JJ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcggccgtacgggaccgaccgacgtaggaaaataggtagaacggaaaccgtagttgggcgttcggcaccaactcctagtctttcctacttcttccccgt

SEQ ID NO: 565087 - DNA, 486 bp, Homo sapiens; identical to SEQ ID NO: 535043
  misc_feature: HIJSMM301ALKC4.46.35.D02.1.454.light.4.raw

SEQ ID NO: 565088 - DNA, 495 bp, Homo sapiens; identical to SEQ ID NO: 538359
  misc_feature: HIJSMM301EXKBT.11.59.F04.1.454.light.4.raw

SEQ ID NO: 565089 - DNA, 484 bp, Homo sapiens
  misc_feature: HIJSMM301CUO1Q.13.10.A10.1.454.light.4.raw
tcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaaggccaaccc

SEQ ID NO: 565090 - DNA, 460 bp, Homo sapiens; identical to SEQ ID NO: 536053
  misc_feature: HIJSMM301EDMAU.22.28.C06.1.454.light.4.raw

SEQ ID NO: 565091 - DNA, 528 bp, Homo sapiens
  misc_feature: HIJSMM301AZQAX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtaggaaggtacgaaacgaaacgtagtggcgtgcaccactctgtcttctactcttcccgtccactctcgat

SEQ ID NO: 565092 - DNA, 441 bp, Homo sapiens; identical to SEQ ID NO: 546257
  misc_feature: HIJSMM301CW7AI.41.9.A09.1.454.light.4.raw

SEQ ID NO: 565093 - DNA, 494 bp, Homo sapiens; identical to SEQ ID NO: 534992
  misc_feature: HIJSMM301C5G02.9.1.A01.1.454.light.4.raw

SEQ ID NO: 565094 - DNA, 486 bp, Homo sapiens; identical to SEQ ID NO: 535523
  misc_feature: HIJSMM301CRACS.22.73.G07.1.454.light.4.raw

SEQ ID NO: 565095 - DNA, 502 bp, Homo sapiens
  misc_feature: HIJSMM301B1ESE.26.23.C01.1.454.light.4.raw
  modified_base (490)..(490): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgtcggtccacggggaccgaacggtaggaagtacgaagacggaactagtggcgtcgnaccaactctgtt

SEQ ID NO: 565096 - DNA, 485 bp, Homo sapiens; identical to SEQ ID NO: 535880
  misc_feature: HIJSMM301EQFF8.7.75.G09.1.454.light.4.raw

SEQ ID NO: 565097 - DNA, 513 bp, Homo sapiens
  misc_feature: HIJSMM301CP2B9.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccct

SEQ ID NO: 565098 - DNA, 493 bp, Homo sapiens
  misc_feature: HIJSMM301CP504.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagtggcggtggatctagggcagatttcactctcaccatcaatcacctgcaggctgaggattttgcaacttactaactgtcagcaggctaacaggctgccccaacctcggtccagggacgacgactggaggattaaacgaaactagtggcgttgcaccat

SEQ ID NO: 565099 - DNA, 519 bp, Homo sapiens
  misc_feature: HIJSMM301BL0U2.53.65.F10.1.454.light.4.raw
cgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaagctgaccgtcctaggtcagcccaaggctgccccctcggtcactctgttcccgccctcctctcgta

SEQ ID NO: 565100 - DNA, 489 bp, Homo sapiens; identical to SEQ ID NO: 535139
  misc_feature: HIJSMM301CHNMP.14.55.E11.1.454.light.4.raw

SEQ ID NO: 565101 - DNA, 486 bp, Homo sapiens; identical to SEQ ID NO: 535290
  misc_feature: HIJSMM301DN3LP.3.12.B01.1.454.light.4.raw

SEQ ID NO: 565102 - DNA, 468 bp, Homo sapiens
  misc_feature: HIJSMM301BXEET.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtacaaaagaatagcgctgccccgctcagtttcggcggagggaccaaggtggagatacg

SEQ ID NO: 565103 - DNA, 454 bp, Homo sapiens; identical to SEQ ID NO: 534964
  misc_feature: HIJSMM301EAEFX.19.86.H09.1.454.light.4.raw

SEQ ID NO: 565104 - DNA, 491 bp, Homo sapiens; identical to SEQ ID NO: 535194
  misc_feature: HIJSMM301ESRVU.26.78.H01.1.454.light.4.raw

SEQ ID NO: 565105 - DNA, 484 bp, Homo sapiens; identical to SEQ ID NO: 535400
  misc_feature: HIJSMM301AY9JW.46.26.C04.1.454.light.4.raw

SEQ ID NO: 565106 - DNA, 479 bp, Homo sapiens; identical to SEQ ID NO: 535118
  misc_feature: HIJSMM301CH4GI.13.59.F04.1.454.light.4.raw

SEQ ID NO: 565107 - DNA, 454 bp, Homo sapiens; identical to SEQ ID NO: 534964
  misc_feature: HIJSMM301APTXA.19.86.H09.1.454.light.4.raw

SEQ ID NO: 565108 - DNA, 501 bp, Homo sapiens
  misc_feature: HIJSMM301CHPJ2.52.87.H10.1.454.light.4.raw
cgcagtacgacacgaccggtgctcgatttagcagtactgcgttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 565109 - DNA, 492 bp, Homo sapiens
  misc_feature: HIJSMM301DLRAQ.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcagggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtccg

SEQ ID NO: 565110 - DNA, 464 bp, Homo sapiens; identical to SEQ ID NO: 537214
  misc_feature: HIJSMM301AWG2N.18.59.F04.1.454.light.4.raw

SEQ ID NO: 565111 - DNA, 481 bp, Homo sapiens; identical to SEQ ID NO: 560961
  misc_feature: HIJSMM301B8YYF.13.5.A05.1.454.light.4.raw

SEQ ID NO: 565112 - DNA, 447 bp, Homo sapiens; identical to SEQ ID NO: 535201
  misc_feature: HIJSMM301EH2FF.18.9.A09.1.454.light.4.raw

SEQ ID NO: 565113 - DNA, 500 bp, Homo sapiens; identical to SEQ ID NO: 542669
  misc_feature: HIJSMM301B2IY7.18.11.A11.1.454.light.4.raw

SEQ ID NO: 565114 - DNA, 510 bp, Homo sapiens
  misc_feature: HIJSMM301A1HEQ.10.27.C05.1.454.light.4.raw
catagtagtgcacgaccggtgctcgatttagacgcgatcgaaggggtttggggggggtcgacaagaggcagcgctctcgggacgtctccaccatggcctgggctctgctgctcctcaccctcctcactcaggacacagggtccgtgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 565115 - DNA, 520 bp, Homo sapiens; identical to SEQ ID NO: 539176
  misc_feature: HIJSMM301AXLY5.27.23.C01.1.454.light.4.raw

SEQ ID NO: 565116 - DNA, 498 bp, Homo sapiens
  misc_feature: HIJSMM301ALNJZ.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccaccctctcgtatctctcg

SEQ ID NO: 565117 - DNA, 491 bp, Homo sapiens; identical to SEQ ID NO: 539402
  misc_feature: HIJSMM301A5VII.13.5.A05.1.454.light.4.raw

SEQ ID NO: 565118 - DNA, 482 bp, Homo sapiens
  misc_feature: HIJSMM301DA4KC.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatacaaacgaactgtggctgcaccta

SEQ ID NO: 565119 - DNA, 401 bp, Homo sapiens
  misc_feature: HIJSMM301DK0I3.52.83.H06.1.454.light.4.raw
cgcagtacgacacgaccggtgctcgatttagatcacgtgcgtcgcggggcggggcacttctccctctaacactctcccctgttgaagctctttgtgacgggcgagtcaggacattagcaattatttaaattggtatcagcagaaaccagggaaagcccctaaactcctgatctacgatgcatccaatttggaaacagggtcccatcaaggttcagtggaagtggttctgggacacattttacttcaccatcagcggcctgcagcctgaagatattgcaacatattactgtcaacagtatggtaatctcccactcactttcggcggagggaccaaggtcgagatcaaacgaactgtggctgcaccatctgtcttcatcttcccgccatctgatatacgatcg

SEQ ID NO: 565120 - DNA, 458 bp, Homo sapiens
  misc_feature: HIJSMM301EWE0W.11.86.H09.1.454.light.4.raw
cgagagataccacgaccggtgctcgatttagtgctatagacttgggtttgggggccgttcctgggcccagtctgtgctgactcagccaccctcagcgtctgggacccccggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctctatctctcg

SEQ ID NO: 565121 - DNA, 519 bp, Homo sapiens
  misc_feature: HIJSMM301A4H88.3.87.H10.1.454.light.4.raw
  modified_base (435)..(435): a, c, t, g, unknown or other
  modified_base (505)..(505): a, c, t, g, unknown or other
  modified_base (516)..(516): a, c, t, g, unknown or other
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacanaacccggcaccactgtcgtggtttttcggtggagggaccaagctgaccgtcctaggtcagcccaaggctnccccctcggtnact

SEQ ID NO: 565122 - DNA, 447 bp, Homo sapiens; identical to SEQ ID NO: 535201
  misc_feature: HIJSMM301CTTTB.18.9.A09.1.454.light.4.raw

SEQ ID NO: 565123 - DNA, 505 bp, Homo sapiens; identical to SEQ ID NO: 536254
  misc_feature: HIJSMM301BJSY8.7.71.G05.1.454.light.4.raw

SEQ ID NO: 565124 - DNA, 490 bp, Homo sapiens
  misc_feature: HIJSMM301DW9IB.16.68.G02.1.454.light.4.raw
  modified_base (483)..(483): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcacagcctgcaacctgatgattttgcaacttattaactgccaacagtatcatcatcattgtaatttcggtggagggaaccaaggtggaggtcaaacaaactgtggctgcaccatcngtcttac

SEQ ID NO: 565125 - DNA, 495 bp, Homo sapiens
  misc_feature: HIJSMM301BGDF9.49.27.C05.1.454.light.4.raw
agtcgagagacacgaccggtgctcgatttagacgcgatcgaagggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 565126 - DNA, 525 bp, Homo sapiens
  misc_feature: HIJSMM301CLLQ6.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactcctgttcccgccctccctccgtcg

SEQ ID NO: 565127 - DNA, 493 bp, Homo sapiens; identical to SEQ ID NO: 536289
  misc_feature: HIJSMM301BTSNF.14.5.A05.1.454.light.4.raw

SEQ ID NO: 565128 - DNA, 501 bp, Homo sapiens
  misc_feature: HIJSMM301DDQ0E.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgctagtttattactgtcagcagcgtagcaactggcctccgatcaccttcggccaagggacacgactggagattaaacgaactgtggctgcaccatctgtcttcatt

SEQ ID NO: 565129 - DNA, 488 bp, Homo sapiens
  misc_feature: HIJSMM301BVCA8.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaattattttagtgctccgtacacttttggccaggggaccaagttggagatcaaacgaa

SEQ ID NO: 565130 - DNA, 504 bp, Homo sapiens
  misc_feature: HIJSMM301BIAZA.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgtaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcg

SEQ ID NO: 565131 - DNA, 460 bp, Homo sapiens; identical to SEQ ID NO: 536053
  misc_feature: HIJSMM301EFGGU.22.28.C06.1.454.light.4.raw

SEQ ID NO: 565132 - DNA, 485 bp, Homo sapiens
  misc_feature: HIJSMM301AJWRQ.41.72.G06.1.454.light.4.raw
tctatactatcacgaccggtgctcgatttagctacgactgcaagggaaaggggaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaacatagcctccctgaccattactggactccagcctgaggacgaggctgactattactgctcagcatgggacagcagcctcaatgtttgggtgttcggcggagggccaagctgaccgtcctaggtcagcccc

SEQ ID NO: 565133 - DNA, 503 bp, Homo sapiens; identical to SEQ ID NO: 537189
  misc_feature: HIJSMM301CAWMJ.19.85.H08.1.454.light.4.raw

SEQ ID NO: 565134 - DNA, 497 bp, Homo sapiens
  misc_feature: HIJSMM301ANWGP.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtaggaaatcaaacgaactgtggctgcacc

SEQ ID NO: 565135 - DNA, 488 bp, Homo sapiens; identical to SEQ ID NO: 535568
  misc_feature: HIJSMM301BH4OS.21.4.A04.1.454.light.4.raw

SEQ ID NO: 565136 - DNA, 441 bp, Homo sapiens; identical to SEQ ID NO: 534971
  misc_feature: HIJSMM301C5YLZ.11.3.A03.1.454.light.4.raw

SEQ ID NO: 565137 - DNA, 490 bp, Homo sapiens
  misc_feature: HIJSMM301C1TVY.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggttataccttcctcggactttcggtccctcgggtaccacgagtggatgtcaacgaactagt

SEQ ID NO: 565138 - DNA, 505 bp, Homo sapiens
  misc_feature: HIJSMM301EIVU9.17.33.C11.1.454.light.4.raw
cgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactatactgcctactctactttggtggtgctgtgctattcggcggaggaccaagctgacgtcttaagtcagcccaaggctgccccctcggtcactctgttcccg

SEQ ID NO: 565139 - DNA, 488 bp, Homo sapiens
  misc_feature: HIJSMM301CT8AR.49.34.D01.1.454.light.4.raw
agtcgagagacacgaccggtgctcgatttagatcgtctgtgttggggtttggggaggagtcagtctcagtcaggacacagcatggacatgagggtccccgctcagctcctggggctcctgctactctggctccgaggtgccagatgtgacatcctgactgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtgggtcccatcaaggttcagtggcagtggatctgggacagaattcactctcaccatcagcagtctgcaacctgaagtattttggaaagttactattgtcaacagagttacggaaacttgctcattttccggacggtagggaccaaggtggagatcaaacgaactgtggctgca

SEQ ID NO: 565140 - DNA, 512 bp, Homo sapiens
  misc_feature: HIJSMM301BDNWH.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactcttcg

SEQ ID NO: 565141 - DNA, 497 bp, Homo sapiens; identical to SEQ ID NO: 546748
  misc_feature: HIJSMM301AJA67.43.37.D04.1.454.light.4.raw

SEQ ID NO: 565142 - DNA, 512 bp, Homo sapiens
  misc_feature: HIJSMM301D1IPV.17.33.C11.1.454.light.4.raw
cgtagactagcacgaccggtgctcgatttagagtgagctcgttggggtttggggtctggcgccaggggtcccttccaatatcagcaccatggcctggactcctctctttctgttcctcctcacttgctgcccagggtccaattctcagactgtggtgtactcaggagccctcacctgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggcctaaggctgaccgtcttaagtcagcccaaggctgccccctggtcactctgttccca

SEQ ID NO: 565143 - DNA, 493 bp, Homo sapiens; identical to SEQ ID NO: 535745
  misc_feature: HIJSMM301AKUYL.47.78.H01.1.454.light.4.raw

SEQ ID NO: 565144 - DNA, 469 bp, Homo sapiens
  misc_feature: HIJSMM301CKVGA.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatcaagcgaa

SEQ ID NO: 565145 - DNA, 487 bp, Homo sapiens
  misc_feature: HIJSMM301A4N66.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgtggtctgacgacttcgcagtctatttctgtcaacagtacgatggccggcctccgtggacattcggccaaggtaccaaggtggacattcagacgaactgtggctgcacc

SEQ ID NO: 565146 - DNA, 447 bp, Homo sapiens; identical to SEQ ID NO: 535020
  misc_feature: HIJSMM301AVXRW.18.9.A09.1.454.light.4.raw

SEQ ID NO: 565147 - DNA, 491 bp, Homo sapiens
  misc_feature: HIJSMM301AD3SP.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtccgacggaccgacggtggagtgtctaagacgaactacgtggcgtgtcgaccact

SEQ ID NO: 565148 - DNA, 511 bp, Homo sapiens
  misc_feature: HIJSMM301DV11V.17.33.C11.1.454.light.4.raw
  modified_base (505)..(505): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttcccncctcct

SEQ ID NO: 565149 - DNA, 494 bp, Homo sapiens; identical to SEQ ID NO: 534994
  misc_feature: HIJSMM301DCT3D.27.78.H01.1.454.light.4.raw

SEQ ID NO: 565150 - DNA, 495 bp, Homo sapiens; identical to SEQ ID NO: 535821
  misc_feature: HIJSMM301AEEE6.3.31.C09.1.454.light.4.raw

SEQ ID NO: 565151 - DNA, 497 bp, Homo sapiens; identical to SEQ ID NO: 535286
  misc_feature: HIJSMM301DQ61E.18.59.F04.1.454.light.4.raw

SEQ ID NO: 565152 - DNA, 423 bp, Homo sapiens
  misc_feature: HIJSMM301CC268.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctcggtcactctgttcccgccctcctcagacgtatca

SEQ ID NO: 565153 - DNA, 485 bp, Homo sapiens; identical to SEQ ID NO: 547563
  misc_feature: HIJSMM301AO754.3.77.G11.1.454.light.4.raw

SEQ ID NO: 565154 - DNA, 491 bp, Homo sapiens; identical to SEQ ID NO: 564347
  misc_feature: HIJSMM301DAKKA.22.65.F10.1.454.light.4.raw

SEQ ID NO: 565155 - DNA, 481 bp, Homo sapiens
  misc_feature: HIJSMM301EGF9M.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtgggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcaccatt

SEQ ID NO: 565156 - DNA, 482 bp, Homo sapiens; identical to SEQ ID NO: 535352
  misc_feature: HIJSMM301BDZZA.16.81.H04.1.454.light.4.raw

SEQ ID NO: 565157 - DNA, 484 bp, Homo sapiens; identical to SEQ ID NO: 550343
  misc_feature: HIJSMM301CYAJY.40.81.H04.1.454.light.4.raw

SEQ ID NO: 565158 - DNA, 494 bp, Homo sapiens
  misc_feature: HIJSMM301C3Z3O.48.36.D03.1.454.light.4.raw
agtatacatacacgaccggtgctcgatttagctgcgtcacgatctctcttgggaccggtgctcgatttagctgcgtcacgatctctcttggggggggtcgtcaggaggcagcactctcgggacggtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcagttcctttttgtcttcgaactc

SEQ ID NO: 565159 - DNA, 515 bp, Homo sapiens
  misc_feature: HIJSMM301AE8A9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagtattttgcagtattattactgtcagcaatatggtacttcacccggacgtcgtcgacggacgaaggtaggagtacgaacgaactagtgcgtgcgaccactactcgtcttctactcttcccgtccactct

SEQ ID NO: 565160 - DNA, 522 bp, Homo sapiens; identical to SEQ ID NO: 541090
  misc_feature: HIJSMM301BG9O2.27.23.C01.1.454.light.4.raw

SEQ ID NO: 565161 - DNA, 472 bp, Homo sapiens; identical to SEQ ID NO: 547391
  misc_feature: HIJSMM301CQB2F.5.70.G04.1.454.light.4.raw

SEQ ID NO: 565162 - DNA, 496 bp, Homo sapiens; identical to SEQ ID NO: 537249
  misc_feature: HIJSMM301EGBR9.16.78.H01.1.454.light.4.raw

SEQ ID NO: 565163 - DNA, 474 bp, Homo sapiens; identical to SEQ ID NO: 534975
  misc_feature: HIJSMM301AR5AO.40.59.F04.1.454.light.4.raw

SEQ ID NO: 565164 - DNA, 509 bp, Homo sapiens
  misc_feature: HIJSMM301DEXQ0.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaagagccaccctctcctgcagggccagtcagagtgttcgcacttcgttagggtgtatcaacataaatccggccaggctcccaggctcctcatctttgatgctttcaacacgggcccctggcgtcccaggcaggttcagtggcaggtgggtctgggacagacttcactctcaccatcagcagcctagagcctgaagattttgctagtttattactgtcagcagcgtgcctactttcggcggaggtgccactttcggcggagggaccaaatagaggtacaaacgaactgtggctgcaccatctgtcttcattccc

SEQ ID NO: 565165 - DNA, 505 bp, Homo sapiens; identical to SEQ ID NO: 535503
  misc_feature: HIJSMM301COKER.8.28.C06.1.454.light.4.raw

SEQ ID NO: 565166 - DNA, 501 bp, Homo sapiens
  misc_feature: HIJSMM301BQZ6X.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgccctcccacagggccactggcactcccacacaggttcagtggcagtgggtctgggacagacttcagtctcaccatcagcagcctagagcctgaggattttgcaatttatttctgtcaacagcgtagcacctgggccccgggtcaccgttcggccaagggacacgactggacatgaaacgactgtggctgcaccatctgtcttca

SEQ ID NO: 565167 - DNA, 447 bp, Homo sapiens; identical to SEQ ID NO: 535020
  misc_feature: HIJSMM301ERPGR.18.9.A09.1.454.light.4.raw

SEQ ID NO: 565168 - DNA, 480 bp, Homo sapiens; identical to SEQ ID NO: 535291
  misc_feature: HIJSMM301D8CZE.22.59.F04.1.454.light.4.raw

SEQ ID NO: 565169 - DNA, 498 bp, Homo sapiens; identical to SEQ ID NO: 546411
  misc_feature: HIJSMM301BUI97.48.59.F04.1.454.light.4.raw

SEQ ID NO: 565170 - DNA, 500 bp, Homo sapiens; identical to SEQ ID NO: 547703
  misc_feature: HIJSMM301CHJEZ.43.34.D01.1.454.light.4.raw

SEQ ID NO: 565171 - DNA, 492 bp, Homo sapiens; identical to SEQ ID NO: 537666
  misc_feature: HIJSMM301DU6U4.43.33.C11.1.454.light.4.raw

SEQ ID NO: 565172 - DNA, 502 bp, Homo sapiens
  misc_feature: HIJSMM301BPOUC.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataattccctccgtggacgttcggccaagggaccaaggagcaaatacaaacgaactgtggctgcaccatctgtcttcattccttcccgccatcct

SEQ ID NO: 565173 - DNA, 496 bp, Homo sapiens; identical to SEQ ID NO: 535541
  misc_feature: HIJSMM301AZCO5.3.33.C11.1.454.light.4.raw

SEQ ID NO: 565174 - DNA, 491 bp, Homo sapiens; identical to SEQ ID NO: 538388
  misc_feature: HIJSMM301C5NN7.51.81.H04.1.454.light.4.raw

SEQ ID NO: 565175 - DNA, 510 bp, Homo sapiens; identical to SEQ ID NO: 535855
  misc_feature: HIJSMM301AESER.17.33.C11.1.454.light.4.raw

SEQ ID NO: 565176 - DNA, 484 bp, Homo sapiens; identical to SEQ ID NO: 538157
  misc_feature: HIJSMM301C4J3B.26.70.G04.1.454.light.4.raw

SEQ ID NO: 565177 - DNA, 497 bp, Homo sapiens
  misc_feature: HIJSMM301A2WW4.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaacaatattattatactttcgtggaccgttcggccaagggaccaaggtggatatcagacgaactgtggctgca

SEQ ID NO: 565178 - DNA, 494 bp, Homo sapiens; identical to SEQ ID NO: 534992
  misc_feature: HIJSMM301BAEIP.9.1.A01.1.454.light.4.raw

SEQ ID NO: 565179 - DNA, 496 bp, Homo sapiens
  misc_feature: HIJSMM301CIR4U.48.48.E04.1.454.light.4.raw
agtatacatacacgaccggtgctcgatttagagagcgtcacagagagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 565180 - DNA, 483 bp, Homo sapiens
  misc_feature: HIJSMM301DO7AO.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttggccagggaccgaaggtaggaaatacaaacgaactagtggcgtgcacca

SEQ ID NO: 565181 - DNA, 501 bp, Homo sapiens; identical to SEQ ID NO: 536867
  misc_feature: HIJSMM301B1V24.5.86.H09.1.454.light.4.raw

SEQ ID NO: 565182 - DNA, 509 bp, Homo sapiens
  misc_feature: HIJSMM301ETJVP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccgaacggtggaaagtacaaacgaactagtggctgcaccatctgtcttcatcttccccg

SEQ ID NO: 565183 - DNA, 512 bp, Homo sapiens
  misc_feature: HIJSMM301EA30J.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctgttctcgccctcctcagacgtat

SEQ ID NO: 565184 - DNA, 464 bp, Homo sapiens; identical to SEQ ID NO: 536640
  misc_feature: HIJSMM301A9M13.26.78.H01.1.454.light.4.raw

SEQ ID NO: 565185 - DNA, 487 bp, Homo sapiens; identical to SEQ ID NO: 537573
  misc_feature: HIJSMM301ANBUP.3.10.A10.1.454.light.4.raw

SEQ ID NO: 565186 - DNA, 486 bp, Homo sapiens; identical to SEQ ID NO: 535917
  misc_feature: HIJSMM301CIZXO.3.10.A10.1.454.light.4.raw

SEQ ID NO: 565187 - DNA, 503 bp, Homo sapiens
  misc_feature: HIJSMM301DGI00.16.49.E05.1.454.light.4.raw
tgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgtccccccg

SEQ ID NO: 565188 - DNA, 501 bp, Homo sapiens
  misc_feature: HIJSMM301DGLO1.40.33.C11.1.454.light.4.raw
tctagcgactcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtgggggtgccacttgggtgttcggcggagggaccaagctgaccgtcctaggtcagcccaaggctgccccctc

SEQ ID NO: 565189 - DNA, 494 bp, Homo sapiens; identical to SEQ ID NO: 534992
  misc_feature: HIJSMM301B5LT4.9.1.A01.1.454.light.4.raw

SEQ ID NO: 565190 - DNA, 493 bp, Homo sapiens
  misc_feature: HIJSMM301AE11N.4.11.A11.1.454.light.4.raw
agcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcggggtggccaccatcaactgcaagtccagccagagtcttttatacgggtccgacggtaagaattatttagcttggtatcagcaaaagccaggacagcctcctaagttgctcatttactgggcgactttccgtgattacggggtccctctccggttcagtggcggcgggtctgggacagacttcactctcaccatcgacagcctgcaggatgaagatgtggcagtctatttctgtcagcaatattatactactcccccggacattcggccaagggaccaaggtggagatcaagcgaactgtggctgcaccatctgtcttcatcttcccgccat

SEQ ID NO: 565191 - DNA, 490 bp, Homo sapiens
  misc_feature: HIJSMM301B5GNZ.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcgccaggaccacagtggatatcaggcgaactgtggctgcaccatctgtctt

SEQ ID NO: 565192 - DNA, 501 bp, Homo sapiens
  misc_feature: HIJSMM301EDO1M.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctccactttcggcggagggaccaaggtggagatcaaacgaactgtggctgcacca

SEQ ID NO: 565193 - DNA, 479 bp, Homo sapiens; identical to SEQ ID NO: 535118
  misc_feature: HIJSMM301DBE6L.13.59.F04.1.454.light.4.raw

SEQ ID NO: 565194 - DNA, 502 bp, Homo sapiens
  misc_feature: HIJSMM301EPW15.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgaccaagggaccaaggtggaaatcaaacgaactagtggctgcaccatctgtcttcatcttcccg

SEQ ID NO: 565195 - DNA, 495 bp, Homo sapiens; identical to SEQ ID NO: 542299
  misc_feature: HIJSMM301AQYYW.22.86.H09.1.454.light.4.raw

SEQ ID NO: 565196 - DNA, 454 bp, Homo sapiens; identical to SEQ ID NO: 535005
  misc_feature: HIJSMM301DZ7KH.19.86.H09.1.454.light.4.raw

SEQ ID NO: 565197 - DNA, 472 bp, Homo sapiens; identical to SEQ ID NO: 536302
  misc_feature: HIJSMM301BBJU7.18.76.G10.1.454.light.4.raw

SEQ ID NO: 565198 - DNA, 489 bp, Homo sapiens
  misc_feature: HIJSMM301BF8QM.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagttttcggcggagggaccaaggtggagatacaaacgaactgtggctgcacatctgt

SEQ ID NO: 565199 - DNA, 447 bp, Homo sapiens; identical to SEQ ID NO: 535201
  misc_feature: HIJSMM301D0Z0S.18.9.A09.1.454.light.4.raw

SEQ ID NO: 565200 - DNA, 464 bp, Homo sapiens; identical to SEQ ID NO: 542703
  misc_feature: HIJSMM301D673U.11.73.G07.1.454.light.4.raw

SEQ ID NO: 565201 - DNA, 446 bp, Homo sapiens; identical to SEQ ID NO: 539491
  misc_feature: HIJSMM301EIGQJ.18.9.A09.1.454.light.4.raw

SEQ ID NO: 565202 - DNA, 489 bp, Homo sapiens; identical to SEQ ID NO: 537328
  misc_feature: HIJSMM301C9LFS.13.5.A05.1.454.light.4.raw

SEQ ID NO: 565203 - DNA, 492 bp, Homo sapiens
  misc_feature: HIJSMM301EEK2T.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaaccg

SEQ ID NO: 565204 - DNA, 484 bp, Homo sapiens; identical to SEQ ID NO: 535400
  misc_feature: HIJSMM301EWMZ5.46.26.C04.1.454.light.4.raw

SEQ ID NO: 565205 - DNA, 487 bp, Homo sapiens
  misc_feature: HIJSMM301DGT0L.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccaggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcacttttcggcccttgggaccgaagtcgatatcaaacgaactgtggctgcaccatct

SEQ ID NO: 565206 - DNA, 486 bp, Homo sapiens
  misc_feature: HIJSMM301AKMSG.5.6.A06.1.454.light.4.raw
atcagacacgcacgaccggtgctcgatttagatctactgacagggggcaggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaacggtggaaatacaaacgaactagtggctgcaccatct

SEQ ID NO: 565207 - DNA, 515 bp, Homo sapiens; identical to SEQ ID NO: 553540
  misc_feature: HIJSMM301BSTLO.22.36.D03.1.454.light.4.raw

SEQ ID NO: 565208 - DNA, 479 bp, Homo sapiens; identical to SEQ ID NO: 537141
  misc_feature: HIJSMM301BB0YP.7.76.G10.1.454.light.4.raw

SEQ ID NO: 565209 - DNA, 503 bp, Homo sapiens; identical to SEQ ID NO: 538973
  misc_feature: HIJSMM301BLAO1.5.86.H09.1.454.light.4.raw

SEQ ID NO: 565210 - DNA, 492 bp, Homo sapiens; identical to SEQ ID NO: 534967
  misc_feature: HIJSMM301DSWX6.47.64.F09.1.454.light.4.raw

SEQ ID NO: 565211 - DNA, 490 bp, Homo sapiens
  misc_feature: HIJSMM301C4IAQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttatgataccccgtggacgttcggccagggaccgaaggtggagatcaaacgaactagtggctgcaccatctgtcttcta

SEQ ID NO: 565212 - DNA, 503 bp, Homo sapiens; identical to SEQ ID NO: 535140
  misc_feature: HIJSMM301D17ZE.18.37.D04.1.454.light.4.raw

SEQ ID NO: 565213 - DNA, 460 bp, Homo sapiens; identical to SEQ ID NO: 536053
  misc_feature: HIJSMM301BIM2J.22.28.C06.1.454.light.4.raw

SEQ ID NO: 565214 - DNA, 494 bp, Homo sapiens; identical to SEQ ID NO: 534994
  misc_feature: HIJSMM301CK016.27.78.H01.1.454.light.4.raw

SEQ ID NO: 565215 - DNA, 504 bp, Homo sapiens; identical to SEQ ID NO: 535935
  misc_feature: HIJSMM301BG43L.18.78.H01.1.454.light.4.raw

SEQ ID NO: 565216 - DNA, 494 bp, Homo sapiens; identical to SEQ ID NO: 534994
  misc_feature: HIJSMM301A83FK.27.78.H01.1.454.light.4.raw

SEQ ID NO: 565217 - DNA, 486 bp, Homo sapiens; identical to SEQ ID NO: 535043
  misc_feature: HIJSMM301CWBJP.46.35.D02.1.454.light.4.raw

SEQ ID NO: 565218 - DNA, 487 bp, Homo sapiens; identical to SEQ ID NO: 536206
  misc_feature: HIJSMM301AJ88Z.47.38.D05.1.454.light.4.raw

SEQ ID NO: 565219 - DNA, 499 bp, Homo sapiens; identical to SEQ ID NO: 545133
  misc_feature: HIJSMM301C5PSV.48.83.H06.1.454.light.4.raw

SEQ ID NO: 565220 - DNA, 499 bp, Homo sapiens; identical to SEQ ID NO: 547044
  misc_feature: HIJSMM301DIOFK.43.71.G05.1.454.light.4.raw

SEQ ID NO: 565221 - DNA, 504 bp, Homo sapiens; identical to SEQ ID NO: 535561
  misc_feature: HIJSMM301C4JYO.4.57.F02.1.454.light.4.raw

SEQ ID NO: 565222 - DNA, 493 bp, Homo sapiens; identical to SEQ ID NO: 537281
  misc_feature: HIJSMM301CZ8K6.9.1.A01.1.454.light.4.raw

SEQ ID NO: 565223 - DNA, 489 bp, Homo sapiens; identical to SEQ ID NO: 535139
  misc_feature: HIJSMM301CPN9J.14.55.E11.1.454.light.4.raw

SEQ ID NO: 565224 - DNA, 485 bp, Homo sapiens
  misc_feature: HIJSMM301ELWC1.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctaggaaactaaacgaactgtggctgcacc

SEQ ID NO: 565225 - DNA, 515 bp, Homo sapiens
  misc_feature: HIJSMM301A3BDK.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgaccctcct

SEQ ID NO: 565226 - DNA, 503 bp, Homo sapiens; identical to SEQ ID NO: 555463
  misc_feature: HIJSMM301BQM3L.43.14.B03.1.454.light.4.raw

SEQ ID NO: 565227 - DNA, 494 bp, Homo sapiens; identical to SEQ ID NO: 534992
  misc_feature: HIJSMM301BBLKO.9.1.A01.1.454.light.4.raw

SEQ ID NO: 565228 - DNA, 498 bp, Homo sapiens
  misc_feature: HIJSMM301DDLD5.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaagagccaccctctcctgcagggccagtcagagtattagcaacaacttagcctggtaccagcagagacctggccaggctcccaggctcctcatctatgttgcacccagcagggccactcggtaccccagccaggttcagtggcagtgggtctgggacagagttcactctcaccatcagcagcctgcagtctgaagattttgctagtttattactgtcagcagtataattactggcctcggacgtcgtccgacggacgaacgaggagacaacgaactacgtggcgtgcaccactctgtcttcta

SEQ ID NO: 565229 - DNA, 489 bp, Homo sapiens
  misc_feature: HIJSMM301AKELW.3.29.C07.1.454.light.4.raw
agacgcactccacgaccggtgctcgatttagagtgctacgaagggaaagggggcaggagtcagtcccaaccaggacacagcatggacatgagggtccctgctcagctcctggggctcctgctgctctggctctcaggtgccagatgtgacatgcagatgacccagtctccctcctccctgtctgcatctgtgggagacagcgtcaccatcacttgccaggcgagtcaggacattagcacctatttaaattggtatcaacagaagccagggaaagcccctaaagtcctaatatatgatgcatccaagttgcaaacaggggtcccatccaggttcaggggaggtggatctgggacacactttactctcaccatcagcagcctgcagcctgaagattttgcaacatatttttgtcaacattatgacaatgtccccccgtacaccttttggcctaggggaccaaggtggagatcaaacgactagtgctgcacc

SEQ ID NO: 565230 - DNA, 490 bp, Homo sapiens; identical to SEQ ID NO: 535526
  misc_feature: HIJSMM301CGS9G.26.78.H01.1.454.light.4.raw

SEQ ID NO: 565231 - DNA, 485 bp, Homo sapiens; identical to SEQ ID NO: 535985
  misc_feature: HIJSMM301D7U1B.15.1.A01.1.454.light.4.raw

SEQ ID NO: 565232 - DNA, 507 bp, Homo sapiens; identical to SEQ ID NO: 538063
  misc_feature: HIJSMM301CJKPL.47.85.H08.1.454.light.4.raw

SEQ ID NO: 565233 - DNA, 478 bp, Homo sapiens; identical to SEQ ID NO: 541928
  misc_feature: HIJSMM301D9ESI.7.76.G10.1.454.light.4.raw

SEQ ID NO: 565234 - DNA, 486 bp, Homo sapiens
  misc_feature: HIJSMM301C1769.13.87.H10.1.454.light.4.raw
tcacgtactacacgaccggtgctcgatttagcagtactgcgttgggtttgggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtgctgcaccatctgtcttca

SEQ ID NO: 565235 - DNA, 484 bp, Homo sapiens; identical to SEQ ID NO: 535240
  misc_feature: HIJSMM301E1ROD.47.60.F05.1.454.light.4.raw

SEQ ID NO: 565236 - DNA, 416 bp, Homo sapiens; identical to SEQ ID NO: 536892
  misc_feature: HIJSMM301ARSN5.16.46.E02.1.454.light.4.raw

SEQ ID NO: 565237 - DNA, 486 bp, Homo sapiens; identical to SEQ ID NO: 537127
  misc_feature: HIJSMM301AH31F.3.77.G11.1.454.light.4.raw

SEQ ID NO: 565238 - DNA, 513 bp, Homo sapiens; identical to SEQ ID NO: 559561
  misc_feature: HIJSMM301DEDQX.17.33.C11.1.454.light.4.raw
  modified_base (507)..(507): a, c, t, g, unknown or other

SEQ ID NO: 565239 - DNA, 496 bp, Homo sapiens
  misc_feature: HIJSMM301B8PTS.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagaggcgcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 565240 - DNA, 504 bp, Homo sapiens; identical to SEQ ID NO: 549905
  misc_feature: HIJSMM301BC57G.48.71.G05.1.454.light.4.raw

SEQ ID NO: 565241 - DNA, 492 bp, Homo sapiens; identical to SEQ ID NO: 535939
  misc_feature: HIJSMM301DODDN.13.5.A05.1.454.light.4.raw

SEQ ID NO: 565242 - DNA, 483 bp, Homo sapiens
  misc_feature: HIJSMM301CGCIV.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcacttattactgtctccagtatgatgcttaccctcggactttggccaagggaccaaggtggaaatcaaacgaactagtggctgcaccta

SEQ ID NO: 565243 - DNA, 495 bp, Homo sapiens; identical to SEQ ID NO: 535596
  misc_feature: HIJSMM301B3APA.10.79.H02.1.454.light.4.raw

SEQ ID NO: 565244 - DNA, 502 bp, Homo sapiens
  misc_feature: HIJSMM301BJFZU.48.83.H06.1.454.light.4.raw
agtatacatacacgaccggtgctcgatttagatcacgtgcgtcgcggggggggtgagggtttagaacctatgaacattctgtaggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagccc

SEQ ID NO: 565245 - DNA, 498 bp, Homo sapiens; identical to SEQ ID NO: 560707
  misc_feature: HIJSMM301ARL9O.10.79.H02.1.454.light.4.raw

SEQ ID NO: 565246 - DNA, 500 bp, Homo sapiens
  misc_feature: HIJSMM301DVEDC.48.22.B11.1.454.light.4.raw
agtatacatacacgaccggtgctcgatttagacgacagctcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 565247 - DNA, 492 bp, Homo sapiens; identical to SEQ ID NO: 542973
  misc_feature: HIJSMM301DMH9H.13.11.A11.1.454.light.4.raw

SEQ ID NO: 565248 - DNA, 488 bp, Homo sapiens; identical to SEQ ID NO: 554125
  misc_feature: HIJSMM301EKPUW.53.34.D01.1.454.light.4.raw

SEQ ID NO: 565249 - DNA, 518 bp, Homo sapiens
  misc_feature: HIJSMM301AOKXE.19.80.H03.1.454.light.4.raw
  modified_base (506)..(506): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccnccctcctccacg

SEQ ID NO: 565250 - DNA, 447 bp, Homo sapiens; identical to SEQ ID NO: 549542
  misc_feature: HIJSMM301CEWRR.18.9.A09.1.454.light.4.raw

SEQ ID NO: 565251 - DNA, 505 bp, Homo sapiens
  misc_feature: HIJSMM301EQ4WF.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcacttttcggcggagggaccaaggtggagatcagacgaactgtggctgcaccatctgtcttcatcttccccg

SEQ ID NO: 565252 - DNA, 494 bp, Homo sapiens; identical to SEQ ID NO: 536974
  misc_feature: HIJSMM301DCCL7.16.86.H09.1.454.light.4.raw

SEQ ID NO: 565253 - DNA, 489 bp, Homo sapiens; identical to SEQ ID NO: 535139
  misc_feature: HIJSMM301BASQZ.14.55.E11.1.454.light.4.raw

SEQ ID NO: 565254 - DNA, 491 bp, Homo sapiens; identical to SEQ ID NO: 535294
  misc_feature: HIJSMM301CVZB2.16.68.G02.1.454.light.4.raw

SEQ ID NO: 565255 - DNA, 498 bp, Homo sapiens; identical to SEQ ID NO: 547576
  misc_feature: HIJSMM301C5D9L.12.37.D04.1.454.light.4.raw

SEQ ID NO: 565256 - DNA, 509 bp, Homo sapiens
  misc_feature: HIJSMM301AOS42.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccacactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgtttttttcggtcggtcgggaccaagctgaccgtcctaggtcagcccaaggctgccccctcggtccta

SEQ ID NO: 565257 - DNA, 480 bp, Homo sapiens
  misc_feature: HIJSMM301EJXYE.12.19.B08.1.454.light.4.raw
atacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgcaaagtggggtcccatcaaggttcagtggcagtggatctgggacagatttcactctcaccatcagcggtctgcaacctgaagattttgcaacttacttctgtcaacagagttacaatacccctccgtcacctgcggccaagggacacgg

SEQ ID NO: 565258 - DNA, 515 bp, Homo sapiens
  misc_feature: HIJSMM301DPHTU.3.59.F04.1.454.light.4.raw
agacgcactccacgaccggtgctcgatttagtacacacacttagggattggggagcttcagctgtgggtagagaagacaggactcaggacaatctccagcatggccagcttccctctcctcctcaccctcctcgctcactgtgcagggtcctgggcccagtctgtgctgactcaggcaccctcagcgtctggggcccccggacagagagtcaccattttttgttctggaagcagctccaacatcggaaggaataatgtaaactggtaccaacaccttccaggatcggcccccaaacacctcatctatagtaataatgagcgcccctcaggggtcccggtccgattctctggctccaggtctggcacctcagcctccctggccatcagtgggctccagtctgacgatgaggctgattattactgttcatcttgggattccaactcaataatcggatattcggcggagggaccaagctgaccgtcctgggtcagcccaaggctgccccctcggtcta

SEQ ID NO: 565259 - DNA, 513 bp, Homo sapiens
  misc_feature: HIJSMM301BSSN6.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 565260 - DNA, 497 bp, Homo sapiens; identical to SEQ ID NO: 535740
  misc_feature: HIJSMM301ANUDD.3.71.G05.1.454.light.4.raw

SEQ ID NO: 565261 - DNA, 496 bp, Homo sapiens
  misc_feature: HIJSMM301C9BE7.40.57.F02.1.454.light.4.raw
tctagcgactcacgaccggtgctcgatttagctcgatatagttggggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtctacgtcagccaaggctcg

SEQ ID NO: 565262 - DNA, 492 bp, Homo sapiens; identical to SEQ ID NO: 563079
  misc_feature: HIJSMM301EM4BW.15.59.F04.1.454.light.4.raw

SEQ ID NO: 565263 - DNA, 490 bp, Homo sapiens; identical to SEQ ID NO: 547085
  misc_feature: HIJSMM301CBRCZ.12.51.E07.1.454.light.4.raw

SEQ ID NO: 565264 - DNA, 482 bp, Homo sapiens; identical to SEQ ID NO: 540521
  misc_feature: HIJSMM301EY4VU.21.25.C03.1.454.light.4.raw

SEQ ID NO: 565265 - DNA, 487 bp, Homo sapiens
  misc_feature: HIJSMM301DK620.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggccaagctggagatcaggcgtaacg

SEQ ID NO: 565266 - DNA, 509 bp, Homo sapiens
  misc_feature: HIJSMM301DDKG4.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaacgcccccaaactgatgatttatgatgtcaataatcggccctcaggggtttctaatcgcttctctggctccaagtctggcaacacggcctccctgaccatctctgggctccaggggtgaggacgaggctgattattactgcagctcatttacaagcagcaccactcaggtcttcggaactgggactaaggtcaccgtcctaggtcagcccaaggcccaacccatgtcact

SEQ ID NO: 565267 - DNA, 445 bp, Homo sapiens
  misc_feature: HIJSMM301EM4O6.8.73.G07.1.454.light.4.raw
  modified_base (420)..(420): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggttgaggatgaggctgattattactgccactcctatgacaacagcctgagtatttggctgttcggcggcgggaccaagttgaccgtcctacgtcagcccaaggctgccccctcggtcactcngttcccaccctcctcgacacgcgag

SEQ ID NO: 565268 - DNA, 486 bp, Homo sapiens; identical to SEQ ID NO: 535043
  misc_feature: HIJSMM301A7ZP2.46.35.D02.1.454.light.4.raw

SEQ ID NO: 565269 - DNA, 485 bp, Homo sapiens; identical to SEQ ID NO: 539951
  misc_feature: HIJSMM301ELQX4.4.26.C04.1.454.light.4.raw

SEQ ID NO: 565270 - DNA, 519 bp, Homo sapiens
  misc_feature: HIJSMM301A248Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacgtcctaggtcagcccaaggctgcccctcggtcactctgttcccaccct

SEQ ID NO: 565271 - DNA, 505 bp, Homo sapiens
  misc_feature: HIJSMM301AKUGE.16.1.A01.1.454.light.4.raw
tgtactactccacgaccggtgctcgatttagacgtctcatcgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagccccaaactcatcatttatgaagtctctaagcggccctcaggggtatctaatcgcttctctggctcaagtctggcaacacggcctccctgaccgtctctggcctccagactgaggacgaggctgattattactgccactcatatagaagtagtactactcctgtggttttcggcggtaggaccaagctgaccgtctaggtcagccaaggctgccccctcggtcactctgtt

SEQ ID NO: 565272 - DNA, 469 bp, Homo sapiens
  misc_feature: HIJSMM301DOVW1.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcgaccaagggaccaaggtggaaatcaaacgaactgtggctgcaccatctgtcttcatcttcccgccatctgaatagtataga

SEQ ID NO: 565273 - DNA, 486 bp, Homo sapiens; identical to SEQ ID NO: 562202
  misc_feature: HIJSMM301BP28W.43.4.A04.1.454.light.4.raw

SEQ ID NO: 565274 - DNA, 485 bp, Homo sapiens
  misc_feature: HIJSMM301DEM1C.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggccccctatacttttggccaggggaccaagctggagatcacaggaactgtggctgcacc

SEQ ID NO: 565275 - DNA, 410 bp, Homo sapiens; identical to SEQ ID NO: 546025
  misc_feature: HIJSMM301A7FK4.10.86.H09.1.454.light.4.raw

SEQ ID NO: 565276 - DNA, 493 bp, Homo sapiens; identical to SEQ ID NO: 539394
  misc_feature: HIJSMM301COFXU.10.79.H02.1.454.light.4.raw

SEQ ID NO: 565277 - DNA, 456 bp, Homo sapiens
  misc_feature: HIJSMM301BCO3L.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctaggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctcgttcccaccctcctccacgagagta

SEQ ID NO: 565278 - DNA, 494 bp, Homo sapiens; identical to SEQ ID NO: 535276
  misc_feature: HIJSMM301EFC4E.16.6.A06.1.454.light.4.raw

SEQ ID NO: 565279 - DNA, 503 bp, Homo sapiens; identical to SEQ ID NO: 563319
  misc_feature: HIJSMM301DI02I.9.12.B01.1.454.light.4.raw

SEQ ID NO: 565280 - DNA, 480 bp, Homo sapiens; identical to SEQ ID NO: 535409
  misc_feature: HIJSMM301BUSAI.4.74.G08.1.454.light.4.raw

SEQ ID NO: 565281 - DNA, 496 bp, Homo sapiens
  misc_feature: HIJSMM301C9B3X.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaacgaactgtggctgcacc

SEQ ID NO: 565282 - DNA, 512 bp, Homo sapiens
  misc_feature: HIJSMM301BS1JE.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgtttcggcgggggaccaagctgaccgtcctaggtcagcccaaggctgccccctcggtcactctcg

SEQ ID NO: 565283 - DNA, 493 bp, Homo sapiens
  misc_feature: HIJSMM301DZA4N.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagcccc

SEQ ID NO: 565284 - DNA, 423 bp, Homo sapiens
  misc_feature: HIJSMM301EM1CX.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgcccctcctcagacgtatca

SEQ ID NO: 565285 - DNA, 482 bp, Homo sapiens
  misc_feature: HIJSMM301B7ITB.49.87.H10.1.454.light.4.raw
agtcgagagacacgaccggtgctcgatttagcagtactgcgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccagggaccaagctggagatcaagcgaactgtggctgcaccat

SEQ ID NO: 565286 - DNA, 478 bp, Homo sapiens; identical to SEQ ID NO: 535129
  misc_feature: HIJSMM301DU7LB.11.11.A11.1.454.light.4.raw

SEQ ID NO: 565287 - DNA, 503 bp, Homo sapiens
  misc_feature: HIJSMM301COOL1.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaacgtaggacagtacaagacgaactagtggctggcaccaactcctgtt

SEQ ID NO: 565288 - DNA, 507 bp, Homo sapiens
  misc_feature: HIJSMM301EI53H.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaaggctggaccgtcctcgggtcagcccaaggctgccccctcggtcca

SEQ ID NO: 565289 - DNA, 499 bp, Homo sapiens; identical to SEQ ID NO: 555664
  misc_feature: HIJSMM301D4YEP.40.42.D09.1.454.light.4.raw

SEQ ID NO: 565290 - DNA, 454 bp, Homo sapiens; identical to SEQ ID NO: 536347
  misc_feature: HIJSMM301BIBJ4.19.86.H09.1.454.light.4.raw

SEQ ID NO: 565291 - DNA, 489 bp, Homo sapiens
  misc_feature: HIJSMM301BMB4Z.49.45.E01.1.454.light.4.raw
agtcgagagacacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttcccgccatctgat

SEQ ID NO: 565292 - DNA, 479 bp, Homo sapiens; identical to SEQ ID NO: 547479
  misc_feature: HIJSMM301BTAQH.16.81.H04.1.454.light.4.raw

SEQ ID NO: 565293 - DNA, 487 bp, Homo sapiens; identical to SEQ ID NO: 540408
  misc_feature: HIJSMM301BOB82.41.33.C11.1.454.light.4.raw

SEQ ID NO: 565294 - DNA, 509 bp, Homo sapiens
  misc_feature: HIJSMM301DSJ0R.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgcctccc

SEQ ID NO: 565295 - DNA, 520 bp, Homo sapiens; identical to SEQ ID NO: 539176
  misc_feature: HIJSMM301DHISW.27.23.C01.1.454.light.4.raw

SEQ ID NO: 565296 - DNA, 471 bp, Homo sapiens
  misc_feature: HIJSMM301BG58I.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggtcggggggaccgaaggtggagatcaagcgaa

SEQ ID NO: 565297 - DNA, 511 bp, Homo sapiens; identical to SEQ ID NO: 537047
  misc_feature: HIJSMM301A7X6Z.5.27.C05.1.454.light.4.raw

SEQ ID NO: 565298 - DNA, 497 bp, Homo sapiens
  misc_feature: HIJSMM301B62IB.52.37.D04.1.454.light.4.raw
cgcagtacgacacgaccggtgctcgatttagtagcatactgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagccaaggctgccccctcggtcta

SEQ ID NO: 565299 - DNA, 447 bp, Homo sapiens
  misc_feature: HIJSMM301EQMVJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccgggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 565300 - DNA, 487 bp, Homo sapiens; identical to SEQ ID NO: 537208
  misc_feature: HIJSMM301AH85X.3.55.E11.1.454.light.4.raw

SEQ ID NO: 565301 - DNA, 507 bp, Homo sapiens
  misc_feature: HIJSMM301B9UK7.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctcgccccctcggt

SEQ ID NO: 565302 - DNA, 491 bp, Homo sapiens
  misc_feature: HIJSMM301CKQ75.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgc

SEQ ID NO: 565303 - DNA, 507 bp, Homo sapiens
  misc_feature: HIJSMM301ECVFI.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 565304 - DNA, 490 bp, Homo sapiens
  misc_feature: HIJSMM301C4OJK.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcta

SEQ ID NO: 565305 - DNA, 503 bp, Homo sapiens; identical to SEQ ID NO: 536579
  misc_feature: HIJSMM301EKQTU.27.78.H01.1.454.light.4.raw

SEQ ID NO: 565306 - DNA, 491 bp, Homo sapiens; identical to SEQ ID NO: 535194
  misc_feature: HIJSMM301EZVOH.26.78.H01.1.454.light.4.raw

SEQ ID NO: 565307 - DNA, 514 bp, Homo sapiens; identical to SEQ ID NO: 546238
  misc_feature: HIJSMM301AG5K6.47.85.H08.1.454.light.4.raw

SEQ ID NO: 565308 - DNA, 507 bp, Homo sapiens
  misc_feature: HIJSMM301BUJTY.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcacctgtgcgttgtatatggttttggcatttcggtgttcggcggagggacccaggtgaccgtcctacgtcagccc

SEQ ID NO: 565309 - DNA, 504 bp, Homo sapiens; identical to SEQ ID NO: 535561
  misc_feature: HIJSMM301BV92C.4.57.F02.1.454.light.4.raw

SEQ ID NO: 565310 - DNA, 504 bp, Homo sapiens; identical to SEQ ID NO: 542288
  misc_feature: HIJSMM301A3Z8N.8.28.C06.1.454.light.4.raw

SEQ ID NO: 565311 - DNA, 503 bp, Homo sapiens
  misc_feature: HIJSMM301ELYFL.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactaatactattcggcggagggaccaagctgaccgtcctgcgtcagcccaaggctgccccctcggtcactc

SEQ ID NO: 565312 - DNA, 490 bp, Homo sapiens
  misc_feature: HIJSMM301A05UV.48.37.D04.1.454.light.4.raw
agtatacatacacgaccggtgctcgatttagtagcatactgttgggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 565313 - DNA, 502 bp, Homo sapiens
  misc_feature: HIJSMM301CZ8P6.9.53.E09.1.454.light.4.raw
  modified_base (472)..(472): a, c, t, g, unknown or other
tgatacgtctcacgaccggtgctcgatttagagagagtgtgttgggtttgggggggtcacaagaggcagcgctctcgggacgtctccaccatggcctgggctctgctgctccctcaccctcctcactcaggacacagggtccgtgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggccaaggtnaccgtctaggtcagcccaaggctgcccccc

SEQ ID NO: 565314 - DNA, 514 bp, Homo sapiens
  misc_feature: HIJSMM301BILU7.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagccctccctgaccatcagtgggctccggtccgaggatgaggctgattattactgtgcaccgtgggatgacatcctgaatggtccggtgttcggcggagggaccaggctgaccgtcctaagtcagccccaaggctcgtccccccg

SEQ ID NO: 565315 - DNA, 504 bp, Homo sapiens; identical to SEQ ID NO: 558952
  misc_feature: HIJSMM301BCRQ0.22.15.B04.1.454.light.4.raw

SEQ ID NO: 565316 - DNA, 507 bp, Homo sapiens; identical to SEQ ID NO: 563344
  misc_feature: HIJSMM301AYL1N.3.79.H02.1.454.light.4.raw

SEQ ID NO: 565317 - DNA, 480 bp, Homo sapiens
  misc_feature: HIJSMM301CXRUU.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaaggcc

SEQ ID NO: 565318 - DNA, 468 bp, Homo sapiens
  misc_feature: HIJSMM301B6GV2.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcgaagtggatctgggacagattttaattcaccatcagcagcctcaacgtgatgatgttgcaacatactattgtcagcaatatgattttgctcctccgagtgccacttttggcgggggaccaaggtggacatcaaacgaa

SEQ ID NO: 565319 - DNA, 444 bp, Homo sapiens; identical to SEQ ID NO: 535192
  misc_feature: HIJSMM301EPZYN.5.9.A09.1.454.light.4.raw

SEQ ID NO: 565320 - DNA, 505 bp, Homo sapiens; identical to SEQ ID NO: 536232
  misc_feature: HIJSMM301C1PMA.47.65.F10.1.454.light.4.raw

SEQ ID NO: 565321 - DNA, 454 bp, Homo sapiens; identical to SEQ ID NO: 534964
  misc_feature: HIJSMM301C6L74.19.86.H09.1.454.light.4.raw

SEQ ID NO: 565322 - DNA, 444 bp, Homo sapiens; identical to SEQ ID NO: 534993
  misc_feature: HIJSMM301CMMNC.5.9.A09.1.454.light.4.raw

SEQ ID NO: 565323 - DNA, 442 bp, Homo sapiens
  misc_feature: HIJSMM301EV2DW.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctggtcactctgttcccgccctcctcgacgtatca

SEQ ID NO: 565324 - DNA, 447 bp, Homo sapiens; identical to SEQ ID NO: 535201
  misc_feature: HIJSMM301CZ4E6.18.9.A09.1.454.light.4.raw

SEQ ID NO: 565325 - DNA, 504 bp, Homo sapiens; identical to SEQ ID NO: 535128
  misc_feature: HIJSMM301CPHBS.19.85.H08.1.454.light.4.raw

SEQ ID NO: 565326 - DNA, 508 bp, Homo sapiens
  misc_feature: HIJSMM301A8KVM.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattactgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactggaccaaggtcaccgtcctaggtcagccaaggccaacccactgtcactctgttcccacctcctccgtgtctgat

SEQ ID NO: 565327 - DNA, 447 bp, Homo sapiens; identical to SEQ ID NO: 535201
  misc_feature: HIJSMM301ASWCC.18.9.A09.1.454.light.4.raw

SEQ ID NO: 565328 - DNA, 491 bp, Homo sapiens
  misc_feature: HIJSMM301A66FP.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggcctgggaccaaagtggatttcagacgaactgtggctgcaccatctgtcttcta

SEQ ID NO: 565329 - DNA, 500 bp, Homo sapiens
  misc_feature: HIJSMM301BRUTZ.40.53.E09.1.454.light.4.raw
tctagcgactcacgaccggtgctcgatttagagagagtgtgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtgggggtgccacttgggtgttcggcggagggaccaagctgaccgtcctaggtcagcccaaggctgcccctc

SEQ ID NO: 565330 - DNA, 487 bp, Homo sapiens; identical to SEQ ID NO: 536206
  misc_feature: HIJSMM301A4VX7.47.38.D05.1.454.light.4.raw

SEQ ID NO: 565331 - DNA, 488 bp, Homo sapiens
  misc_feature: HIJSMM301CARIR.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggatatcagacgaaa

SEQ ID NO: 565332 - DNA, 486 bp, Homo sapiens; identical to SEQ ID NO: 537127
  misc_feature: HIJSMM301CKSCM.3.77.G11.1.454.light.4.raw

SEQ ID NO: 565333 - DNA, 486 bp, Homo sapiens; identical to SEQ ID NO: 540090
  misc_feature: HIJSMM301CT8XC.17.36.D03.1.454.light.4.raw

SEQ ID NO: 565334 - DNA, 499 bp, Homo sapiens; identical to SEQ ID NO: 537739
  misc_feature: HIJSMM301CFB2T.12.86.H09.1.454.light.4.raw

SEQ ID NO: 565335 - DNA, 507 bp, Homo sapiens; identical to SEQ ID NO: 555714
  misc_feature: HIJSMM301A0HG2.40.67.G01.1.454.light.4.raw

SEQ ID NO: 565336 - DNA, 432 bp, Homo sapiens
  misc_feature: HIJSMM301CQ8OG.10.38.D05.1.454.light.4.raw
catagtagtgcacgaccggtgctcgatttagtatctgatagttgggtttgggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccacctcctccactactatg

SEQ ID NO: 565337 - DNA, 521 bp, Homo sapiens; identical to SEQ ID NO: 538715
  misc_feature: HIJSMM301BLPW7.27.23.C01.1.454.light.4.raw

SEQ ID NO: 565338 - DNA, 506 bp, Homo sapiens
  misc_feature: HIJSMM301BHXTD.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaacaaccggccctcagggatcccagaccgattctctggctcctactcaggaaacacagcttccttgaccatcactgggctcaggcggaagatgaggctgactattattgtaagtccggggacagaagtggtaattacatggtgttcggcggagggaccaagctgaccgtcctacgtcagcccaaggctgcccctcggtcactctcg

SEQ ID NO: 565339 - DNA, 354 bp, Homo sapiens; identical to SEQ ID NO: 535026
  misc_feature: HIJSMM301BKO9Y.19.22.B11.1.454.light.4.raw

SEQ ID NO: 565340 - DNA, 485 bp, Homo sapiens; identical to SEQ ID NO: 535501
  misc_feature: HIJSMM301CXHNN.3.10.A10.1.454.light.4.raw

SEQ ID NO: 565341 - DNA, 492 bp, Homo sapiens
  misc_feature: HIJSMM301CXK4X.48.71.G05.1.454.light.4.raw
agtatacatacacgaccggtgctcgatttagtgtcgtcgcaagagagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgcatctgatatgtatact

SEQ ID NO: 565342 - DNA, 494 bp, Homo sapiens; identical to SEQ ID NO: 540664
  misc_feature: HIJSMM301BHQI7.47.64.F09.1.454.light.4.raw

SEQ ID NO: 565343 - DNA, 501 bp, Homo sapiens
  misc_feature: HIJSMM301D6B5U.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacggactggagattaaacgaactgtggctgcaccatctgtcttcatt

SEQ ID NO: 565344 - DNA, 454 bp, Homo sapiens; identical to SEQ ID NO: 534964
  misc_feature: HIJSMM301AQ6HE.19.86.H09.1.454.light.4.raw

SEQ ID NO: 565345 - DNA, 496 bp, Homo sapiens
  misc_feature: HIJSMM301BVVD4.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaagtaggacatcaagcgaactacgtggctgcaccatctgtt

SEQ ID NO: 565346 - DNA, 507 bp, Homo sapiens
  misc_feature: HIJSMM301EM8OS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaaactgtggctgcaccatctgtt

SEQ ID NO: 565347 - DNA, 488 bp, Homo sapiens
  misc_feature: HIJSMM301EHLRU.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttccccc

SEQ ID NO: 565348 - DNA, 515 bp, Homo sapiens
  misc_feature: HIJSMM301CR4Q6.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctgccccctcggtcactctgttcccgccctcct

SEQ ID NO: 565349 - DNA, 494 bp, Homo sapiens; identical to SEQ ID NO: 534992
  misc_feature: HIJSMM301A3TIX.9.1.A01.1.454.light.4.raw

SEQ ID NO: 565350 - DNA, 491 bp, Homo sapiens; identical to SEQ ID NO: 543766
  misc_feature: HIJSMM301AJ5TH.11.81.H04.1.454.light.4.raw

SEQ ID NO: 565351 - DNA, 504 bp, Homo sapiens; identical to SEQ ID NO: 538423
  misc_feature: HIJSMM301BLFVZ.48.67.G01.1.454.light.4.raw

SEQ ID NO: 565352 - DNA, 506 bp, Homo sapiens; identical to SEQ ID NO: 535058
  misc_feature: HIJSMM301C820I.17.41.D08.1.454.light.4.raw

SEQ ID NO: 565353 - DNA, 504 bp, Homo sapiens; identical to SEQ ID NO: 540636
  misc_feature: HIJSMM301DS0B3.19.67.G01.1.454.light.4.raw

SEQ ID NO: 565354 - DNA, 517 bp, Homo sapiens; identical to SEQ ID NO: 546084
  misc_feature: HIJSMM301EIECV.47.53.E09.1.454.light.4.raw

SEQ ID NO: 565355 - DNA, 499 bp, Homo sapiens
  misc_feature: HIJSMM301A9U11.43.14.B03.1.454.light.4.raw
tgtgagtagtcacgaccggtgctcgatttagtgtgagtagttccgcggggatttagtgtgagtagttccgcggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcacgacct

SEQ ID NO: 565356 - DNA, 511 bp, Homo sapiens; identical to SEQ ID NO: 550438
  misc_feature: HIJSMM301CVXWI.17.33.C11.1.454.light.4.raw

SEQ ID NO: 565357 - DNA, 513 bp, Homo sapiens
  misc_feature: HIJSMM301D6B5Q.17.33.C11.1.454.light.4.raw
  modified_base (464)..(464): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtnttaagtcagcccaaggctgccccctcggtcactctgttcccaccctcct

SEQ ID NO: 565358 - DNA, 485 bp, Homo sapiens; identical to SEQ ID NO: 538956
  misc_feature: HIJSMM301EVO3H.40.69.G03.1.454.light.4.raw

SEQ ID NO: 565359 - DNA, 504 bp, Homo sapiens; identical to SEQ ID NO: 555965
  misc_feature: HIJSMM301BLNWS.48.36.D03.1.454.light.4.raw

SEQ ID NO: 565360 - DNA, 500 bp, Homo sapiens
  misc_feature: HIJSMM301AP4GS.52.87.H10.1.454.light.4.raw
cgcagtacgacacgaccggtgctcgatttagcagtactgcgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 565361 - DNA, 470 bp, Homo sapiens; identical to SEQ ID NO: 535302
  misc_feature: HIJSMM301AXJ16.13.76.G10.1.454.light.4.raw

SEQ ID NO: 565362 - DNA, 444 bp, Homo sapiens; identical to SEQ ID NO: 535594
  misc_feature: HIJSMM301B4MAB.9.9.A09.1.454.light.4.raw

SEQ ID NO: 565363 - DNA, 502 bp, Homo sapiens
  misc_feature: HIJSMM301DF0AN.15.1.A01.1.454.light.4.raw
  modified_base (470)..(470): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtccngcgtcagcccaaggctcgccccctggtcactc

SEQ ID NO: 565364 - DNA, 508 bp, Homo sapiens; identical to SEQ ID NO: 536062
  misc_feature: HIJSMM301D5XZW.11.57.F02.1.454.light.4.raw

SEQ ID NO: 565365 - DNA, 495 bp, Homo sapiens
  misc_feature: HIJSMM301CVHQG.40.3.A03.1.454.light.4.raw
tctagcgactcacgaccggtgctcgatttagagagcgtcacaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatacaacgaactgtggctgcacatctgtcttcatcttccg

SEQ ID NO: 565366 - DNA, 486 bp, Homo sapiens; identical to SEQ ID NO: 535458
  misc_feature: HIJSMM301EL4YL.7.75.G09.1.454.light.4.raw

SEQ ID NO: 565367 - DNA, 507 bp, Homo sapiens
  misc_feature: HIJSMM301A3MU1.15.76.G10.1.454.light.4.raw
  modified_base (402)..(402): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattacngcctactctactttggtggtgctgtgctattcggcggagggaccaagctgaccgtcttaagtcagcccaaggctgccccctggtcactctgttccccactcctcc

SEQ ID NO: 565368 - DNA, 501 bp, Homo sapiens
  misc_feature: HIJSMM301B0BET.51.26.C04.1.454.light.4.raw
cgatcgtatacacgaccggtgctcgatttagtctagcgactttgggtttggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccaggtctgaccgtcctaggtcagcccaaggctgccccctcggtcactctcgtccc

SEQ ID NO: 565369 - DNA, 485 bp, Homo sapiens; identical to SEQ ID NO: 535688
  misc_feature: HIJSMM301EVM3Y.19.5.A05.1.454.light.4.raw

SEQ ID NO: 565370 - DNA, 491 bp, Homo sapiens; identical to SEQ ID NO: 536693
  misc_feature: HIJSMM301BL6JV.19.83.H06.1.454.light.4.raw

SEQ ID NO: 565371 - DNA, 488 bp, Homo sapiens; identical to SEQ ID NO: 535861
  misc_feature: HIJSMM301EWKEU.14.55.E11.1.454.light.4.raw

SEQ ID NO: 565372 - DNA, 493 bp, Homo sapiens
  misc_feature: HIJSMM301BGCLZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcaagggacacgactggagattaaacgaactgtggctgcaccatctgtctt

SEQ ID NO: 565373 - DNA, 506 bp, Homo sapiens
  misc_feature: HIJSMM301BXY3M.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgcccccc

SEQ ID NO: 565374 - DNA, 486 bp, Homo sapiens; identical to SEQ ID NO: 537310
  misc_feature: HIJSMM301BEWL4.15.28.C06.1.454.light.4.raw

SEQ ID NO: 565375 - DNA, 495 bp, Homo sapiens; identical to SEQ ID NO: 537780
  misc_feature: HIJSMM301CSZNK.5.24.C02.1.454.light.4.raw

SEQ ID NO: 565376 - DNA, 495 bp, Homo sapiens; identical to SEQ ID NO: 543631
  misc_feature: HIJSMM301CZDXE.11.59.F04.1.454.light.4.raw

SEQ ID NO: 565377 - DNA, 504 bp, Homo sapiens
  misc_feature: HIJSMM301EE6YC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtcggaaatcaaacgaactagtggctgcaccatctgtcttcatcttccccg

SEQ ID NO: 565378 - DNA, 511 bp, Homo sapiens; identical to SEQ ID NO: 548439
  misc_feature: HIJSMM301CADNR.16.46.E02.1.454.light.4.raw

SEQ ID NO: 565379 - DNA, 493 bp, Homo sapiens
  misc_feature: HIJSMM301C0WQ9.52.42.D09.1.454.light.4.raw
cgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 565380 - DNA, 498 bp, Homo sapiens
  misc_feature: HIJSMM301BNISO.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctagttttttactgtcagcagtatagtaactggcctccgtactacttttggccaggggaccaagctagaaatacaaacgaactgtggctgcaccatctgtcttcta

SEQ ID NO: 565381 - DNA, 496 bp, Homo sapiens; identical to SEQ ID NO: 535541
  misc_feature: HIJSMM301BUWBD.3.33.C11.1.454.light.4.raw

SEQ ID NO: 565382 - DNA, 484 bp, Homo sapiens; identical to SEQ ID NO: 535211
  misc_feature: HIJSMM301CLUZO.47.46.E02.1.454.light.4.raw

SEQ ID NO: 565383 - DNA, 487 bp, Homo sapiens; identical to SEQ ID NO: 536536
  misc_feature: HIJSMM301EDAJK.26.45.E01.1.454.light.4.raw

SEQ ID NO: 565384 - DNA, 463 bp, Homo sapiens; identical to SEQ ID NO: 535062
  misc_feature: HIJSMM301EBVFN.11.73.G07.1.454.light.4.raw

SEQ ID NO: 565385 - DNA, 514 bp, Homo sapiens
  misc_feature: HIJSMM301B1G9U.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgacacgtagaaatagagacgaactacgtggctggcaccaactctcgtcttctactcttcccgt

SEQ ID NO: 565386 - DNA, 480 bp, Homo sapiens; identical to SEQ ID NO: 535291
  misc_feature: HIJSMM301A1JK4.22.59.F04.1.454.light.4.raw

SEQ ID NO: 565387 - DNA, 482 bp, Homo sapiens
  misc_feature: HIJSMM301DD8H0.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttacactgccaacagtcttacggaacctcgtacacttttggccaggggaccaggctggagatcaaacgaactgtggctgcaccatctgtt

SEQ ID NO: 565388 - DNA, 484 bp, Homo sapiens
  misc_feature: HIJSMM301D5DT4.5.34.D01.1.454.light.4.raw
atcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcgccaagggacacgactggagattaaacgaactgtggctgcacca

SEQ ID NO: 565389 - DNA, 493 bp, Homo sapiens; identical to SEQ ID NO: 535657
  misc_feature: HIJSMM301B8TGV.27.78.H01.1.454.light.4.raw

SEQ ID NO: 565390 - DNA, 519 bp, Homo sapiens
  misc_feature: HIJSMM301ALYAJ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagtacttttaccctcaccatcaggggtctacagcctgaagtattttgcgtacttactattgtcaacagagttaccttcctcccccggacgtcgtccgacggaccgaacggtaggaagtacaagacgaactacgtggtcgtcgcaccactctgtcttctactcttcccgt

SEQ ID NO: 565391 - DNA, 508 bp, Homo sapiens
  misc_feature: HIJSMM301EU3UW.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 565392 - DNA, 485 bp, Homo sapiens; identical to SEQ ID NO: 535985
  misc_feature: HIJSMM301EX0FH.15.1.A01.1.454.light.4.raw

SEQ ID NO: 565393 - DNA, 490 bp, Homo sapiens; identical to SEQ ID NO: 535234
  misc_feature: HIJSMM301DXOE1.17.21.B10.1.454.light.4.raw

SEQ ID NO: 565394 - DNA, 484 bp, Homo sapiens; identical to SEQ ID NO: 535400
  misc_feature: HIJSMM301EBXM9.46.26.C04.1.454.light.4.raw

SEQ ID NO: 565395 - DNA, 486 bp, Homo sapiens; identical to SEQ ID NO: 552805
  misc_feature: HIJSMM301CKGFK.3.10.A10.1.454.light.4.raw

SEQ ID NO: 565396 - DNA, 496 bp, Homo sapiens; identical to SEQ ID NO: 536248
  misc_feature: HIJSMM301BXCX9.22.27.C05.1.454.light.4.raw

SEQ ID NO: 565397 - DNA, 483 bp, Homo sapiens; identical to SEQ ID NO: 536691
  misc_feature: HIJSMM301ATQAE.17.26.C04.1.454.light.4.raw

SEQ ID NO: 565398 - DNA, 474 bp, Homo sapiens; identical to SEQ ID NO: 561309
  misc_feature: HIJSMM301CGF5A.5.12.B01.1.454.light.4.raw

SEQ ID NO: 565399 - DNA, 485 bp, Homo sapiens; identical to SEQ ID NO: 538533
  misc_feature: HIJSMM301B4CZJ.47.78.H01.1.454.light.4.raw

SEQ ID NO: 565400 - DNA, 498 bp, Homo sapiens
  misc_feature: HIJSMM301AESWW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagttttattattgtcagcaatattatattcctcctcagacgttcggccaagggaccaaggtggaaatcaaacgaactgtggctgcacca

SEQ ID NO: 565401 - DNA, 503 bp, Homo sapiens
  misc_feature: HIJSMM301C65NC.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtctac

SEQ ID NO: 565402 - DNA, 508 bp, Homo sapiens; identical to SEQ ID NO: 536062
  misc_feature: HIJSMM301D671E.11.57.F02.1.454.light.4.raw

SEQ ID NO: 565403 - DNA, 495 bp, Homo sapiens; identical to SEQ ID NO: 536055
  misc_feature: HIJSMM301AI3F4.47.38.D05.1.454.light.4.raw

SEQ ID NO: 565404 - DNA, 477 bp, Homo sapiens
  misc_feature: HIJSMM301B9OGL.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgcaacttactattgtcaacaggctaacagtttcccgctcaccttcggcgggggaccaaggtggagatcaaacgaactgtggctgcacc

SEQ ID NO: 565405 - DNA, 503 bp, Homo sapiens
  misc_feature: HIJSMM301DK4Z8.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactaaagtcctcctctcacgttcggcggagggaccaaggtggagatcaaacgaactgtggctgcaccatctgtcttca

SEQ ID NO: 565406 - DNA, 505 bp, Homo sapiens
  misc_feature: HIJSMM301DODU2.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaaccctcaccatcaatagcctggaagctgaagatgctgcaacttattactgtcatcagagtactactttacctcaagtgatcaccttcggccaagggacacgactggagattaaaacg

SEQ ID NO: 565407 - DNA, 493 bp, Homo sapiens; identical to SEQ ID NO: 535047
  misc_feature: HIJSMM301AV2PJ.16.53.E09.1.454.light.4.raw

SEQ ID NO: 565408 - DNA, 477 bp, Homo sapiens
  misc_feature: HIJSMM301CXHGT.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgtttcggccaggggaccaaggtcgaaatgagacgaactgtggctgcaccatct

SEQ ID NO: 565409 - DNA, 502 bp, Homo sapiens
  misc_feature: HIJSMM301A2QON.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgctagtttattattgtcagcagtataataactggcctccgtggacgttcggccaagggaccaaggtggaaatacaaacgaactagtggctgcaccatctgtcttcta

SEQ ID NO: 565410 - DNA, 510 bp, Homo sapiens
  misc_feature: HIJSMM301CAPXA.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagcccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagactttcactctcaccatcatcagcctggagcctgaagatgttgcagtttattactgtcaacatcgtaccgagtggcctccgggggccacttcggcccgtcggaccgaaacgtaggaggatcaaacgaaactgtggcgtgcacca

SEQ ID NO: 565411 - DNA, 492 bp, Homo sapiens
  misc_feature: HIJSMM301EY7HA.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtcctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 565412 - DNA, 493 bp, Homo sapiens; identical to SEQ ID NO: 537422
  misc_feature: HIJSMM301B9385.9.34.D01.1.454.light.4.raw

SEQ ID NO: 565413 - DNA, 514 bp, Homo sapiens
  misc_feature: HIJSMM301EJVM9.41.30.C08.1.454.light.4.raw
tctatactatcacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggcccaaccccactgtcactctcgtt

SEQ ID NO: 565414 - DNA, 494 bp, Homo sapiens
  misc_feature: HIJSMM301COABH.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcaccatctgtcttcattcc

SEQ ID NO: 565415 - DNA, 506 bp, Homo sapiens
  misc_feature: HIJSMM301C5MOS.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatacaaacgaaactgtggctgcaccatctgtcttcatcttcccgccat

SEQ ID NO: 565416 - DNA, 484 bp, Homo sapiens
  misc_feature: HIJSMM301A0G5O.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctcccctcactttcggcggagggaccaaggtggagatcagacgaaactgtggctgcaccat

SEQ ID NO: 565417 - DNA, 485 bp, Homo sapiens
  misc_feature: HIJSMM301AEC2R.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgtcggccaagggaccaaggtggaaatacaaacgaactagtgg

SEQ ID NO: 565418 - DNA, 463 bp, Homo sapiens
  misc_feature: HIJSMM301EEDJE.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattaactgtcaacagtatgatagtctcccgctcactttcggcggagggaccaaggtggagatcaaacgaa

SEQ ID NO: 565419 - DNA, 441 bp, Homo sapiens; identical to SEQ ID NO: 534971
  misc_feature: HIJSMM301DJOBP.11.3.A03.1.454.light.4.raw

SEQ ID NO: 565420 - DNA, 507 bp, Homo sapiens
  misc_feature: HIJSMM301DAS1N.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaataagagaacagtgataatttctgggtgttcggcggagggaccaaactgaccgtcctaggtcagcccaaggctcgccccctcggtccactctgtt

SEQ ID NO: 565421 - DNA, 497 bp, Homo sapiens
  misc_feature: HIJSMM301DQ3ZL.52.2.A02.1.454.light.4.raw
cgcagtacgacacgaccggtgctcgatttagactcatctacaggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgttcccgccctcctctatacgatcg

SEQ ID NO: 565422 - DNA, 509 bp, Homo sapiens; identical to SEQ ID NO: 543741
  misc_feature: HIJSMM301ALJ49.17.33.C11.1.454.light.4.raw

SEQ ID NO: 565423 - DNA, 479 bp, Homo sapiens
  misc_feature: HIJSMM301B5DH1.43.63.F08.1.454.light.4.raw
tgtgagtagtcacgaccggtgctcgatttagcgatcgtataaggggagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcaccatctgtctt

SEQ ID NO: 565424 - DNA, 476 bp, Homo sapiens; identical to SEQ ID NO: 541471
  misc_feature: HIJSMM301BV6VJ.13.4.A04.1.454.light.4.raw

SEQ ID NO: 565425 - DNA, 453 bp, Homo sapiens
  misc_feature: HIJSMM301EW4UT.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaattcagcccaaggctgccccctcggtcactctgttcccaccctcctccagagagta

SEQ ID NO: 565426 - DNA, 515 bp, Homo sapiens
  misc_feature: HIJSMM301C922O.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcgg

SEQ ID NO: 565427 - DNA, 485 bp, Homo sapiens; identical to SEQ ID NO: 535606
  misc_feature: HIJSMM301BKJQU.47.46.E02.1.454.light.4.raw

SEQ ID NO: 565428 - DNA, 490 bp, Homo sapiens; identical to SEQ ID NO: 535420
  misc_feature: HIJSMM301AEPH1.3.72.G06.1.454.light.4.raw

SEQ ID NO: 565429 - DNA, 479 bp, Homo sapiens; identical to SEQ ID NO: 547479
  misc_feature: HIJSMM301CQ9YF.16.81.H04.1.454.light.4.raw

SEQ ID NO: 565430 - DNA, 480 bp, Homo sapiens; identical to SEQ ID NO: 535291
  misc_feature: HIJSMM301DZUIG.22.59.F04.1.454.light.4.raw

SEQ ID NO: 565431 - DNA, 388 bp, Homo sapiens
  misc_feature: HIJSMM301BIGGV.41.26.C04.1.454.light.4.raw
tctatactatcacgaccggtgctcgatttagtctagcgactttgggtttgggggtaaaggaagccaccctcctcctgcagggccgagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 565432 - DNA, 490 bp, Homo sapiens; identical to SEQ ID NO: 542820
  misc_feature: HIJSMM301DODEB.11.12.B01.1.454.light.4.raw

SEQ ID NO: 565433 - DNA, 496 bp, Homo sapiens
  misc_feature: HIJSMM301ANRN1.12.23.C01.1.454.light.4.raw
  modified_base (467)..(467): a, c, t, g, unknown or other
atacgacgtacacgaccggtgctcgatttagtacacgtgattagggagttgggggagggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccgaaggtgggngagtcaaacgaactgtggctgcaccatct

SEQ ID NO: 565434 - DNA, 513 bp, Homo sapiens
  misc_feature: HIJSMM301BI9W0.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccc

SEQ ID NO: 565435 - DNA, 503 bp, Homo sapiens; identical to SEQ ID NO: 543938
  misc_feature: HIJSMM301COF8P.4.71.G05.1.454.light.4.raw

SEQ ID NO: 565436 - DNA, 483 bp, Homo sapiens; identical to SEQ ID NO: 541990
  misc_feature: HIJSMM301BJ5S7.46.26.C04.1.454.light.4.raw

SEQ ID NO: 565437 - DNA, 484 bp, Homo sapiens; identical to SEQ ID NO: 535211
  misc_feature: HIJSMM301DY3WC.47.46.E02.1.454.light.4.raw

SEQ ID NO: 565438 - DNA, 497 bp, Homo sapiens
  misc_feature: HIJSMM301B2IJ9.43.33.C11.1.454.light.4.raw
tgtgagtagtcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaactagtggctgcaccatctgtcttcatt

SEQ ID NO: 565439 - DNA, 487 bp, Homo sapiens; identical to SEQ ID NO: 539717
  misc_feature: HIJSMM301CYZN9.26.55.E11.1.454.light.4.raw

SEQ ID NO: 565440 - DNA, 505 bp, Homo sapiens; identical to SEQ ID NO: 535503
  misc_feature: HIJSMM301D8WZJ.8.28.C06.1.454.light.4.raw

SEQ ID NO: 565441 - DNA, 484 bp, Homo sapiens; identical to SEQ ID NO: 538157
  misc_feature: HIJSMM301E1UJV.26.70.G04.1.454.light.4.raw

SEQ ID NO: 565442 - DNA, 484 bp, Homo sapiens; identical to SEQ ID NO: 538247
  misc_feature: HIJSMM301CEJC0.14.53.E09.1.454.light.4.raw

SEQ ID NO: 565443 - DNA, 500 bp, Homo sapiens; identical to SEQ ID NO: 543347
  misc_feature: HIJSMM301D392N.41.18.B07.1.454.light.4.raw

SEQ ID NO: 565444 - DNA, 494 bp, Homo sapiens; identical to SEQ ID NO: 534992
  misc_feature: HIJSMM301BMO3T.9.1.A01.1.454.light.4.raw

SEQ ID NO: 565445 - DNA, 493 bp, Homo sapiens
  misc_feature: HIJSMM301B6IWI.51.41.D08.1.454.light.4.raw
cgatcgtatacacgaccggtgctcgatttagtcacgcgagaaagggaaagggggatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcacc

SEQ ID NO: 565446 - DNA, 487 bp, Homo sapiens
  misc_feature: HIJSMM301DAONN.51.60.F05.1.454.light.4.raw
cgatcgtatacacgaccggtgctcgatttagtacgtcatcagggaaaggggactgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtgg

SEQ ID NO: 565447 - DNA, 487 bp, Homo sapiens
  misc_feature: HIJSMM301ARMI5.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaactttggccaggggaccaagctggagatacaaacgaactgtggctgcaccat

SEQ ID NO: 565448 - DNA, 494 bp, Homo sapiens
  misc_feature: HIJSMM301A3BJ0.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggtcggagggaccaaggtggagatcaaacgaactgtggctgcaccatctgtcttcaatcttcccgccta

SEQ ID NO: 565449 - DNA, 476 bp, Homo sapiens; identical to SEQ ID NO: 538611
  misc_feature: HIJSMM301DWM0Z.7.81.H04.1.454.light.4.raw

SEQ ID NO: 565450 - DNA, 500 bp, Homo sapiens
  misc_feature: HIJSMM301EAJ0N.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagtcaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 565451 - DNA, 473 bp, Homo sapiens; identical to SEQ ID NO: 535262
  misc_feature: HIJSMM301CSSGM.8.67.G01.1.454.light.4.raw

SEQ ID NO: 565452 - DNA, 486 bp, Homo sapiens; identical to SEQ ID NO: 535917
  misc_feature: HIJSMM301C8HK2.3.10.A10.1.454.light.4.raw

SEQ ID NO: 565453 - DNA, 484 bp, Homo sapiens; identical to SEQ ID NO: 538770
  misc_feature: HIJSMM301CPEYZ.4.57.F02.1.454.light.4.raw

SEQ ID NO: 565454 - DNA, 470 bp, Homo sapiens
  misc_feature: HIJSMM301DMJ7Q.4.10.A10.1.454.light.4.raw
  modified_base (406)..(406): a, c, t, g, unknown or other
  modified_base (435)..(435): a, c, t, g, unknown or other
  modified_base (455)..(455): a, c, t, g, unknown or other
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtgggtcccgatcaaggttcagcggcagtggatctgggacagatttcactctcaccatcagcagcctacagcctgaagatttgtcaacttattactgtcaacanacttaataattacacgctcacttgtcggnggaccgaggtaggaggatanaacgaacaatggctg

SEQ ID NO: 565455 - DNA, 418 bp, Homo sapiens
  misc_feature: HIJSMM301DXRJN.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaaagtctggcaacacggcctccctgaccatctctgggctccaggctgaggacgaggctgaattattactgcagctcatatacaagcagcagcactcaagtcttcggaactgggaccaaggtcaccgtcctaggtcagcccaaggccaaccccactgtcactctgttcccacctcctccatactcgta

SEQ ID NO: 565456 - DNA, 415 bp, Homo sapiens; identical to SEQ ID NO: 548345
  misc_feature: HIJSMM301CNRLP.40.36.D03.1.454.light.4.raw

SEQ ID NO: 565457 - DNA, 373 bp, Homo sapiens; identical to SEQ ID NO: 539301
  misc_feature: HIJSMM301EG7VO.21.25.C03.1.454.light.4.raw

SEQ ID NO: 565458 - DNA, 479 bp, Homo sapiens; identical to SEQ ID NO: 536050
  misc_feature: HIJSMM301C9N45.5.73.G07.1.454.light.4.raw

SEQ ID NO: 565459 - DNA, 488 bp, Homo sapiens; identical to SEQ ID NO: 535990
  misc_feature: HIJSMM301EARJR.11.28.C06.1.454.light.4.raw

SEQ ID NO: 565460 - DNA, 502 bp, Homo sapiens
  misc_feature: HIJSMM301BHZQF.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaa

SEQ ID NO: 565461 - DNA, 483 bp, Homo sapiens; identical to SEQ ID NO: 535317
  misc_feature: HIJSMM301CF4P0.4.1.A01.1.454.light.4.raw

SEQ ID NO: 565462 - DNA, 497 bp, Homo sapiens
  misc_feature: HIJSMM301B22Z4.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggtggagggaccaaggtgaccgtcctacgtcagcccaaggctgccccctcggtcactctcg

SEQ ID NO: 565463 - DNA, 494 bp, Homo sapiens; identical to SEQ ID NO: 534994
  misc_feature: HIJSMM301ARRGF.27.78.H01.1.454.light.4.raw

SEQ ID NO: 565464 - DNA, 508 bp, Homo sapiens
  misc_feature: HIJSMM301AI4KW.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaactaagaggtcaacgaactagtggctgcaccact

SEQ ID NO: 565465 - DNA, 489 bp, Homo sapiens; identical to SEQ ID NO: 535091
  misc_feature: HIJSMM301ANNSN.47.36.D03.1.454.light.4.raw

SEQ ID NO: 565466 - DNA, 499 bp, Homo sapiens
  misc_feature: HIJSMM301D1KXC.48.68.G02.1.454.light.4.raw
agtatacatacacgaccggtgctcgatttagtcgatagtgaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaacgggacacgactggagattaacgaactgtggctgcaccatctgtcttcatcttcccg

SEQ ID NO: 565467 - DNA, 491 bp, Homo sapiens
  misc_feature: HIJSMM301BHHBF.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgccaggaccaagtaggacgatcaagcgaactagtggctgcgaccactctgtt

SEQ ID NO: 565468 - DNA, 489 bp, Homo sapiens; identical to SEQ ID NO: 535139
  misc_feature: HIJSMM301A4WNT.14.55.E11.1.454.light.4.raw

SEQ ID NO: 565469 - DNA, 500 bp, Homo sapiens
  misc_feature: HIJSMM301AICNQ.43.41.D08.1.454.light.4.raw
tgtgagtagtcacgaccggtgctcgatttagtcacgcgagaaagggaaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaaactgtggctgcacc

SEQ ID NO: 565470 - DNA, 498 bp, Homo sapiens
  misc_feature: HIJSMM301C8LVG.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgattaccttcggccaagggacacgactggagattaaacgaaactgtggctgcaccatctgtcttcta

SEQ ID NO: 565471 - DNA, 500 bp, Homo sapiens
  misc_feature: HIJSMM301EIRTK.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcgacctgggaccaaggtcaccgtctggt

SEQ ID NO: 565472 - DNA, 454 bp, Homo sapiens; identical to SEQ ID NO: 536347
  misc_feature: HIJSMM301DJFZ0.19.86.H09.1.454.light.4.raw

SEQ ID NO: 565473 - DNA, 471 bp, Homo sapiens
  misc_feature: HIJSMM301BKDWA.51.34.D01.1.454.light.4.raw
cgatcgtatacacgaccggtgctcgatttagatcgtctgtgttgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccaaggtggagatcaagcgaa

SEQ ID NO: 565474 - DNA, 500 bp, Homo sapiens
  misc_feature: HIJSMM301CZD9G.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctggcaccatctgtcttcatcttcccgccatcgacata

SEQ ID NO: 565475 - DNA, 517 bp, Homo sapiens
  misc_feature: HIJSMM301D0SUW.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctggggacgaggctgactattactgcctgctcatatatggtggcgcgtgggtgttcggcggagggaccaagctgaccgtcctgggtcagcccaaggctgccccctcggtcactctgttcccaccctcct

SEQ ID NO: 565476 - DNA, 485 bp, Homo sapiens; identical to SEQ ID NO: 538787
  misc_feature: HIJSMM301C6UOH.49.57.F02.1.454.light.4.raw

SEQ ID NO: 565477 - DNA, 482 bp, Homo sapiens
  misc_feature: HIJSMM301CRLBO.43.87.H10.1.454.light.4.raw
  modified_base (457)..(457): a, c, t, g, unknown or other
tgtgagtagtcacgaccggtgctcgatttagcagtactgcgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcgttgggtgttcggnggagggaccaagctgaccgtcctac

SEQ ID NO: 565478 - DNA, 517 bp, Homo sapiens
  misc_feature: HIJSMM301CP77C.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcacttcgtcctaccctcctcctacg

SEQ ID NO: 565479 - DNA, 521 bp, Homo sapiens
  misc_feature: HIJSMM301DV2EV.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccgcct

SEQ ID NO: 565480 - DNA, 480 bp, Homo sapiens
  misc_feature: HIJSMM301BWX8R.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctcactttcggcggagggaccgagggtggagatcagacgaactgtggctgcaccatctgtcttcatccttcccgccatctgaagtatagtct

SEQ ID NO: 565481 - DNA, 384 bp, Homo sapiens; identical to SEQ ID NO: 555393
  misc_feature: HIJSMM301BGG8G.48.87.H10.1.454.light.4.raw

SEQ ID NO: 565482 - DNA, 444 bp, Homo sapiens; identical to SEQ ID NO: 535192
  misc_feature: HIJSMM301A9QA6.5.9.A09.1.454.light.4.raw

SEQ ID NO: 565483 - DNA, 447 bp, Homo sapiens; identical to SEQ ID NO: 535020
  misc_feature: HIJSMM301D0PB8.18.9.A09.1.454.light.4.raw

SEQ ID NO: 565484 - DNA, 483 bp, Homo sapiens; identical to SEQ ID NO: 537371
  misc_feature: HIJSMM301DR46K.13.55.E11.1.454.light.4.raw

SEQ ID NO: 565485 - DNA, 488 bp, Homo sapiens; identical to SEQ ID NO: 539612
  misc_feature: HIJSMM301DTJPQ.3.55.E11.1.454.light.4.raw

SEQ ID NO: 565486 - DNA, 479 bp, Homo sapiens; identical to SEQ ID NO: 535118
  misc_feature: HIJSMM301CF58M.13.59.F04.1.454.light.4.raw

SEQ ID NO: 565487 - DNA, 502 bp, Homo sapiens; identical to SEQ ID NO: 541501
  misc_feature: HIJSMM301BPD0C.17.27.C05.1.454.light.4.raw

SEQ ID NO: 565488 - DNA, 487 bp, Homo sapiens
  misc_feature: HIJSMM301ASI4P.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccgaaggtggaactacaacgaa

SEQ ID NO: 565489 - DNA, 498 bp, Homo sapiens
  misc_feature: HIJSMM301E0S4G.3.33.C11.1.454.light.4.raw
  modified_base (439)..(439): a, c, t, g, unknown or other
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaanactgttttcggcggagggaccaagctgaccgtcctaggtcagcccaaggctgccccccg

SEQ ID NO: 565490 - DNA, 513 bp, Homo sapiens
  misc_feature: HIJSMM301CUJSL.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacttgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcct

SEQ ID NO: 565491 - DNA, 479 bp, Homo sapiens
  misc_feature: HIJSMM301B97HJ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcgggac

SEQ ID NO: 565492 - DNA, 483 bp, Homo sapiens; identical to SEQ ID NO: 547838
  misc_feature: HIJSMM301DIY5R.46.26.C04.1.454.light.4.raw

SEQ ID NO: 565493 - DNA, 494 bp, Homo sapiens; identical to SEQ ID NO: 539922
  misc_feature: HIJSMM301AMRA7.27.78.H01.1.454.light.4.raw

SEQ ID NO: 565494 - DNA, 488 bp, Homo sapiens; identical to SEQ ID NO: 535990
  misc_feature: HIJSMM301DH0AF.11.28.C06.1.454.light.4.raw

SEQ ID NO: 565495 - DNA, 492 bp, Homo sapiens; identical to SEQ ID NO: 536175
  misc_feature: HIJSMM301E1KVW.19.83.H06.1.454.light.4.raw

SEQ ID NO: 565496 - DNA, 498 bp, Homo sapiens
  misc_feature: HIJSMM301BOPPD.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacaggctccacttcccgttatgtcttcggaggtgggaccatggtcaccgtcctaggtcagcccaagaccaaccccactgt

SEQ ID NO: 565497 - DNA, 497 bp, Homo sapiens; identical to SEQ ID NO: 538296
  misc_feature: HIJSMM301C2JX2.18.11.A11.1.454.light.4.raw

SEQ ID NO: 565498 - DNA, 503 bp, Homo sapiens; identical to SEQ ID NO: 538798
  misc_feature: HIJSMM301AO7LZ.14.86.H09.1.454.light.4.raw

SEQ ID NO: 565499 - DNA, 497 bp, Homo sapiens
  misc_feature: HIJSMM301B3IHC.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccccaaggccaacccccactgtcta

SEQ ID NO: 565500 - DNA, 498 bp, Homo sapiens; identical to SEQ ID NO: 535295
  misc_feature: HIJSMM301BSJ78.15.25.C03.1.454.light.4.raw

SEQ ID NO: 565501 - DNA, 495 bp, Homo sapiens
  misc_feature: HIJSMM301BDDGJ.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcagcaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgcc

SEQ ID NO: 565502 - DNA, 507 bp, Homo sapiens
  misc_feature: HIJSMM301EB4NZ.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccaccct

SEQ ID NO: 565503 - DNA, 486 bp, Homo sapiens
  misc_feature: HIJSMM301BXMT3.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccaggtcaccgtcctaggtcagcccaaggccaacccca

SEQ ID NO: 565504 - DNA, 503 bp, Homo sapiens
  misc_feature: HIJSMM301E0F17.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctggt

SEQ ID NO: 565505 - DNA, 444 bp, Homo sapiens; identical to SEQ ID NO: 534993
  misc_feature: HIJSMM301C6UMY.5.9.A09.1.454.light.4.raw

SEQ ID NO: 565506 - DNA, 506 bp, Homo sapiens; identical to SEQ ID NO: 539926
  misc_feature: HIJSMM301A7QNV.5.24.C02.1.454.light.4.raw

SEQ ID NO: 565507 - DNA, 508 bp, Homo sapiens; identical to SEQ ID NO: 535835
  misc_feature: HIJSMM301D5ALJ.8.34.D01.1.454.light.4.raw

SEQ ID NO: 565508 - DNA, 493 bp, Homo sapiens; identical to SEQ ID NO: 536471
  misc_feature: HIJSMM301AI4TE.3.71.G05.1.454.light.4.raw

SEQ ID NO: 565509 - DNA, 475 bp, Homo sapiens; identical to SEQ ID NO: 537850
  misc_feature: HIJSMM301B9ZC5.13.76.G10.1.454.light.4.raw

SEQ ID NO: 565510 - DNA, 518 bp, Homo sapiens
  misc_feature: HIJSMM301A2NSC.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcaggagtctctcatcgcttctcaggctccaagtctggcaacacggcctccctaaccatctctgggctccagtttgaggacgagtctacttattactgcagttacctttaaattaggcgccactctcgttggttttcggcggaggcaccgaagtgaccgtcctcggtcagcccaaggctcgccccctcggtcacttc

SEQ ID NO: 565511 - DNA, 485 bp, Homo sapiens; identical to SEQ ID NO: 536630
  misc_feature: HIJSMM301AY33T.13.56.F01.1.454.light.4.raw

SEQ ID NO: 565512 - DNA, 502 bp, Homo sapiens
  misc_feature: HIJSMM301CYPQW.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggattgggacgacggtcaccgtcctaggtcagcccaaggcccaaaccccta

SEQ ID NO: 565513 - DNA, 495 bp, Homo sapiens
  misc_feature: HIJSMM301DMWXA.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggaggaccgagctgaccgtcctacgtcagcccaaggctcg

SEQ ID NO: 565514 - DNA, 521 bp, Homo sapiens; identical to SEQ ID NO: 539470
  misc_feature: HIJSMM301ANW84.27.23.C01.1.454.light.4.raw

SEQ ID NO: 565515 - DNA, 483 bp, Homo sapiens
  misc_feature: HIJSMM301CU2MQ.48.59.F04.1.454.light.4.raw
agtatacatacacgaccggtgctcgatttagtacacacacttagggattgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 565516 - DNA, 467 bp, Homo sapiens; identical to SEQ ID NO: 535997
  misc_feature: HIJSMM301ETI7P.5.36.D03.1.454.light.4.raw

SEQ ID NO: 565517 - DNA, 479 bp, Homo sapiens
  misc_feature: HIJSMM301CD8WB.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaatattacgcgctcactttcggcggagggaccaaggtggagatcaaacgaactgtggctgcacca

SEQ ID NO: 565518 - DNA, 484 bp, Homo sapiens; identical to SEQ ID NO: 535400
  misc_feature: HIJSMM301A0XYZ.46.26.C04.1.454.light.4.raw

SEQ ID NO: 565519 - DNA, 455 bp, Homo sapiens
  misc_feature: HIJSMM301B1A46.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtggatatcagacgaactgtggctgcaccatctgtcttcatcttccgccatctgacacgagagta

SEQ ID NO: 565520 - DNA, 483 bp, Homo sapiens; identical to SEQ ID NO: 535778
  misc_feature: HIJSMM301BMI6G.48.84.H07.1.454.light.4.raw

SEQ ID NO: 565521 - DNA, 516 bp, Homo sapiens
  misc_feature: HIJSMM301AK3C4.12.85.H08.1.454.light.4.raw
atacgacgtacacgaccggtgctcgatttagtatcactcagtcgcgggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagcccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgcccccctcggtcactctgttccca

SEQ ID NO: 565522 - DNA, 490 bp, Homo sapiens; identical to SEQ ID NO: 535064
  misc_feature: HIJSMM301BBT7C.10.72.G06.1.454.light.4.raw

SEQ ID NO: 565523 - DNA, 470 bp, Homo sapiens; identical to SEQ ID NO: 535302
  misc_feature: HIJSMM301CJR6Y.13.76.G10.1.454.light.4.raw

SEQ ID NO: 565524 - DNA, 473 bp, Homo sapiens
  misc_feature: HIJSMM301B402E.43.38.D05.1.454.light.4.raw
tgtgagtagtcacgaccggtgctcgatttagtatctgatagttgggtttgggggctttccctggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccaggtggaaagtcaaacgaaactgtggctgcaccatctgtcttcatcttcccgccatctgaactactcaca

SEQ ID NO: 565525 - DNA, 504 bp, Homo sapiens; identical to SEQ ID NO: 535055
  misc_feature: HIJSMM301EJM48.7.71.G05.1.454.light.4.raw

SEQ ID NO: 565526 - DNA, 492 bp, Homo sapiens
  misc_feature: HIJSMM301D7C3C.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccaaactaggatatcagacgaactgtggctgca

SEQ ID NO: 565527 - DNA, 502 bp, Homo sapiens; identical to SEQ ID NO: 541501
  misc_feature: HIJSMM301CN31Y.17.27.C05.1.454.light.4.raw

SEQ ID NO: 565528 - DNA, 507 bp, Homo sapiens; identical to SEQ ID NO: 538063
  misc_feature: HIJSMM301EUME0.47.85.H08.1.454.light.4.raw

SEQ ID NO: 565529 - DNA, 493 bp, Homo sapiens
  misc_feature: HIJSMM301EICLL.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggcccgtcgggaccgacgagtggagtgtcaaacgaactagt

SEQ ID NO: 565530 - DNA, 494 bp, Homo sapiens; identical to SEQ ID NO: 534992
  misc_feature: HIJSMM301BGZY7.9.1.A01.1.454.light.4.raw

SEQ ID NO: 565531 - DNA, 520 bp, Homo sapiens; identical to SEQ ID NO: 535686
  misc_feature: HIJSMM301AWH9T.41.19.B08.1.454.light.4.raw

SEQ ID NO: 565532 - DNA, 497 bp, Homo sapiens
  misc_feature: HIJSMM301ELUJT.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccaagggaccgaacggtaggaagtacaaacgaactagtggctgcaccactctgtt

SEQ ID NO: 565533 - DNA, 486 bp, Homo sapiens; identical to SEQ ID NO: 537617
  misc_feature: HIJSMM301DEBFV.10.53.E09.1.454.light.4.raw

SEQ ID NO: 565534 - DNA, 493 bp, Homo sapiens; identical to SEQ ID NO: 544773
  misc_feature: HIJSMM301EKW1Q.21.47.E03.1.454.light.4.raw

SEQ ID NO: 565535 - DNA, 515 bp, Homo sapiens; identical to SEQ ID NO: 536247
  misc_feature: HIJSMM301BT03Y.14.19.B08.1.454.light.4.raw

SEQ ID NO: 565536 - DNA, 494 bp, Homo sapiens; identical to SEQ ID NO: 539922
  misc_feature: HIJSMM301C5JP1.27.78.H01.1.454.light.4.raw

SEQ ID NO: 565537 - DNA, 508 bp, Homo sapiens
  misc_feature: HIJSMM301AOHVA.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccactctgtcttcat

SEQ ID NO: 565538 - DNA, 489 bp, Homo sapiens
  misc_feature: HIJSMM301EWHBB.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcggtccctcggaccgagagtggagtgtcaacgaactagt

SEQ ID NO: 565539 - DNA, 497 bp, Homo sapiens; identical to SEQ ID NO: 538030
  misc_feature: HIJSMM301ENN2N.40.23.C01.1.454.light.4.raw

SEQ ID NO: 565540 - DNA, 354 bp, Homo sapiens
  misc_feature: HIJSMM301BKVPJ.19.22.B11.1.454.light.4.raw
tactctcgtgcacgaccggtgctcgatttagacgacagctcagggacagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctgggacagatttcactctcacca

SEQ ID NO: 565541 - DNA, 486 bp, Homo sapiens; identical to SEQ ID NO: 535458
  misc_feature: HIJSMM301DCEZ9.7.75.G09.1.454.light.4.raw

SEQ ID NO: 565542 - DNA, 482 bp, Homo sapiens
  misc_feature: HIJSMM301EYQG5.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcgcctggaccaaagtggatatcaaacgaactgtggctgcaccatctgt

SEQ ID NO: 565543 - DNA, 512 bp, Homo sapiens
  misc_feature: HIJSMM301DSNRW.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccaaactgaccgtcctaggtcagcccaaggctgccccctcggtcactctcg

SEQ ID NO: 565544 - DNA, 441 bp, Homo sapiens; identical to SEQ ID NO: 535074
  misc_feature: HIJSMM301A9JPC.11.3.A03.1.454.light.4.raw

SEQ ID NO: 565545 - DNA, 490 bp, Homo sapiens
  misc_feature: HIJSMM301C0Q8V.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaaggcggagatcagacgaactgtggctgcaccatctgtcttcta

SEQ ID NO: 565546 - DNA, 501 bp, Homo sapiens; identical to SEQ ID NO: 555276
  misc_feature: HIJSMM301EXW3C.22.21.B10.1.454.light.4.raw

SEQ ID NO: 565547 - DNA, 482 bp, Homo sapiens; identical to SEQ ID NO: 535352
  misc_feature: HIJSMM301DV2OZ.16.81.H04.1.454.light.4.raw

SEQ ID NO: 565548 - DNA, 494 bp, Homo sapiens; identical to SEQ ID NO: 540664
  misc_feature: HIJSMM301A8GZV.47.64.F09.1.454.light.4.raw

SEQ ID NO: 565549 - DNA, 514 bp, Homo sapiens; identical to SEQ ID NO: 547648
  misc_feature: HIJSMM301CKQW9.16.1.A01.1.454.light.4.raw

SEQ ID NO: 565550 - DNA, 502 bp, Homo sapiens; identical to SEQ ID NO: 541971
  misc_feature: HIJSMM301C64TG.4.39.D06.1.454.light.4.raw

SEQ ID NO: 565551 - DNA, 494 bp, Homo sapiens; identical to SEQ ID NO: 534994
  misc_feature: HIJSMM301B8WIM.27.78.H01.1.454.light.4.raw

SEQ ID NO: 565552 - DNA, 486 bp, Homo sapiens; identical to SEQ ID NO: 543576
  misc_feature: HIJSMM301C3PIH.47.38.D05.1.454.light.4.raw

SEQ ID NO: 565553 - DNA, 496 bp, Homo sapiens; identical to SEQ ID NO: 537225
  misc_feature: HIJSMM301BA5XZ.11.59.F04.1.454.light.4.raw

SEQ ID NO: 565554 - DNA, 503 bp, Homo sapiens; identical to SEQ ID NO: 535044
  misc_feature: HIJSMM301BUXMR.19.78.H01.1.454.light.4.raw

SEQ ID NO: 565555 - DNA, 496 bp, Homo sapiens; identical to SEQ ID NO: 537925
  misc_feature: HIJSMM301BXJXQ.22.14.B03.1.454.light.4.raw

SEQ ID NO: 565556 - DNA, 501 bp, Homo sapiens
  misc_feature: HIJSMM301EH4K1.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccaaggtaggaaatacaaacgaactgtggctgcacc

SEQ ID NO: 565557 - DNA, 482 bp, Homo sapiens
  misc_feature: HIJSMM301BQZ7O.40.62.F07.1.454.light.4.raw
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaaggtggagatgaagggaactgtggctgcacc

SEQ ID NO: 565558 - DNA, 480 bp, Homo sapiens
  misc_feature: HIJSMM301AFKUN.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaaacttattactgtcaacagcttaataattacgcgctcactttcggcggagggaccaaggtaggagaatcaaaacgaactgtggctgcaccat

SEQ ID NO: 565559 - DNA, 491 bp, Homo sapiens
  misc_feature: HIJSMM301DZEYB.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttca

SEQ ID NO: 565560 - DNA, 518 bp, Homo sapiens
  misc_feature: HIJSMM301BUNQT.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggcctgccccctggtccactctcgttccccaccctcctcgagtacgtaca

SEQ ID NO: 565561 - DNA, 490 bp, Homo sapiens; identical to SEQ ID NO: 565545
  misc_feature: HIJSMM301C0I6F.14.55.E11.1.454.light.4.raw

SEQ ID NO: 565562 - DNA, 474 bp, Homo sapiens; identical to SEQ ID NO: 549812
  misc_feature: HIJSMM301DX6BD.11.76.G10.1.454.light.4.raw

SEQ ID NO: 565563 - DNA, 503 bp, Homo sapiens; identical to SEQ ID NO: 535044
  misc_feature: HIJSMM301EH1S0.19.78.H01.1.454.light.4.raw

SEQ ID NO: 565564 - DNA, 444 bp, Homo sapiens; identical to SEQ ID NO: 550016
  misc_feature: HIJSMM301CAWKX.14.76.G10.1.454.light.4.raw

SEQ ID NO: 565565 - DNA, 447 bp, Homo sapiens; identical to SEQ ID NO: 535020
  misc_feature: HIJSMM301C942W.18.9.A09.1.454.light.4.raw

SEQ ID NO: 565566 - DNA, 488 bp, Homo sapiens; identical to SEQ ID NO: 561554
  misc_feature: HIJSMM301DOI0O.26.23.C01.1.454.light.4.raw

SEQ ID NO: 565567 - DNA, 503 bp, Homo sapiens
  misc_feature: HIJSMM301BIJVZ.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgatgattttgcaacttattactgccaacattataatacttattcgtacacttttggccaggggaccaagctggagatacaaacgaactgtggctgcaccatctgtcttcatcttccccg

SEQ ID NO: 565568 - DNA, 478 bp, Homo sapiens
  misc_feature: HIJSMM301BSRO2.40.1.A01.1.454.light.4.raw
tctagcgactcacgaccggtgctcgatttagacgtctcatcagggggcaggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgttttggtccaggggaccaaggtggacgatcaaacgaactgtggctgcacca

SEQ ID NO: 565569 - DNA, 479 bp, Homo sapiens; identical to SEQ ID NO: 565491
  misc_feature: HIJSMM301DEF6Q.21.25.C03.1.454.light.4.raw

SEQ ID NO: 565570 - DNA, 462 bp, Homo sapiens
  misc_feature: HIJSMM301AR7PI.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaa

SEQ ID NO: 565571 - DNA, 486 bp, Homo sapiens
  misc_feature: HIJSMM301EGJBV.5.6.A06.1.454.light.4.raw
atcagacacgcacgaccggtgctcgatttagatctactgacagggggcaggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcaccatctgtt

SEQ ID NO: 565572 - DNA, 479 bp, Homo sapiens; identical to SEQ ID NO: 535118
  misc_feature: HIJSMM301DNJ9C.13.59.F04.1.454.light.4.raw

SEQ ID NO: 565573 - DNA, 493 bp, Homo sapiens
  misc_feature: HIJSMM301BIXLU.47.55.E11.1.454.light.4.raw
agctcacgtacacgaccggtgctcgatttagcactcgcacgttgggtttggggagagagaccccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaaccccactgtcactctgttcccaccctcctctacgtgagct

SEQ ID NO: 565574 - DNA, 497 bp, Homo sapiens
  misc_feature: HIJSMM301C5TU0.48.34.D01.1.454.light.4.raw
agtatacatacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctcg

SEQ ID NO: 565575 - DNA, 475 bp, Homo sapiens
  misc_feature: HIJSMM301EDWW7.52.8.A08.1.454.light.4.raw
cgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggtaccaaggtggagatcaagcgaactgtggcg

SEQ ID NO: 565576 - DNA, 499 bp, Homo sapiens; identical to SEQ ID NO: 543098
  misc_feature: HIJSMM301DO11T.18.59.F04.1.454.light.4.raw

SEQ ID NO: 565577 - DNA, 521 bp, Homo sapiens
  misc_feature: HIJSMM301BRM58.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaacgggaccgaaggtggaaagtacaaaactagtaacgtggtcggcgtcgaccacctactcttcgttcttactacttccccg

SEQ ID NO: 565578 - DNA, 494 bp, Homo sapiens
  misc_feature: HIJSMM301EC7LM.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccaggggactaagctggagatcaaacgaactgtggctgcaccatctgtcttcatcttcccg

SEQ ID NO: 565579 - DNA, 497 bp, Homo sapiens
  misc_feature: HIJSMM301CS8TY.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtggacagtccaagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttggccaaggaccgaaggtggaaatacaaacgaaacagtggcgtgcaccatctgtcttc

SEQ ID NO: 565580 - DNA, 462 bp, Homo sapiens; identical to SEQ ID NO: 549716
  misc_feature: HIJSMM301DCL45.11.73.G07.1.454.light.4.raw

SEQ ID NO: 565581 - DNA, 500 bp, Homo sapiens
  misc_feature: HIJSMM301AUXNJ.53.35.D02.1.454.light.4.raw
cgcgtatacacacgaccggtgctcgatttagcacacgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtca

SEQ ID NO: 565582 - DNA, 491 bp, Homo sapiens; identical to SEQ ID NO: 535194
  misc_feature: HIJSMM301EME14.26.78.H01.1.454.light.4.raw

SEQ ID NO: 565583 - DNA, 488 bp, Homo sapiens; identical to SEQ ID NO: 536851
  misc_feature: HIJSMM301EOXUP.41.2.A02.1.454.light.4.raw

SEQ ID NO: 565584 - DNA, 509 bp, Homo sapiens
  misc_feature: HIJSMM301AP1IH.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcgtccgtcggtacgacgagtggagtagtactaaacgaaactacgtggtcgtgcgaccactctgtcttctactcttcccgt

SEQ ID NO: 565585 - DNA, 498 bp, Homo sapiens
  misc_feature: HIJSMM301CUZYU.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaaggtggaggatcaaacgaaactgtggctgcacccat

SEQ ID NO: 565586 - DNA, 495 bp, Homo sapiens; identical to SEQ ID NO: 539489
  misc_feature: HIJSMM301AUFJ1.51.59.F04.1.454.light.4.raw

SEQ ID NO: 565587 - DNA, 492 bp, Homo sapiens; identical to SEQ ID NO: 537666
  misc_feature: HIJSMM301ANCVN.43.33.C11.1.454.light.4.raw

SEQ ID NO: 565588 - DNA, 491 bp, Homo sapiens
  misc_feature: HIJSMM301ERLLH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacacttcggcaagggcacgactggagattaaaggaactgtggctgcaccatctgtcttcatcttccccg

SEQ ID NO: 565589 - DNA, 487 bp, Homo sapiens
  misc_feature: HIJSMM301BD1RU.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccgacggggaccgaaacgtaggagtgtcaaccgaacctagtggcgtgcaccta

SEQ ID NO: 565590 - DNA, 506 bp, Homo sapiens
  misc_feature: HIJSMM301AH8N2.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctcgtt

SEQ ID NO: 565591 - DNA, 481 bp, Homo sapiens
  misc_feature: HIJSMM301C2QUP.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccgtgctggagattgtcctgagtgctgcctcttgtgcccacagctgaagcagagcctccaaactcctcatctatggtaacagcaatcggccctcaggggtccctgaccgattctctggctccaagtctggcacctcagcatccctggtcatcgctgggctccaggctgacgatgaggctgattattattgccagtcctatgacaacaccctgcgtggttttggctgttcggcggcgggacc

SEQ ID NO: 565592 - DNA, 506 bp, Homo sapiens
  misc_feature: HIJSMM301C8O8O.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatctgtcttcactcttccccg

SEQ ID NO: 565593 - DNA, 510 bp, Homo sapiens
  misc_feature: HIJSMM301B5B8S.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcaggcccaaggccaaccccactgtcactctgtt

SEQ ID NO: 565594 - DNA, 514 bp, Homo sapiens
  misc_feature: HIJSMM301DOUXU.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttccccg

SEQ ID NO: 565595 - DNA, 495 bp, Homo sapiens; identical to SEQ ID NO: 549777
  misc_feature: HIJSMM301BKJ0J.51.35.D02.1.454.light.4.raw

SEQ ID NO: 565596 - DNA, 441 bp, Homo sapiens
  misc_feature: HIJSMM301BG0OI.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccactctcctcgtatctctcg

SEQ ID NO: 565597 - DNA, 505 bp, Homo sapiens; identical to SEQ ID NO: 555744
  misc_feature: HIJSMM301C2U1C.7.71.G05.1.454.light.4.raw

SEQ ID NO: 565598 - DNA, 441 bp, Homo sapiens; identical to SEQ ID NO: 534971
  misc_feature: HIJSMM301BX552.11.3.A03.1.454.light.4.raw

SEQ ID NO: 565599 - DNA, 447 bp, Homo sapiens; identical to SEQ ID NO: 535882
  misc_feature: HIJSMM301CLZ5H.18.9.A09.1.454.light.4.raw
  modified_base (429)..(429): a, c, t, g, unknown or other

SEQ ID NO: 565600 - DNA, 447 bp, Homo sapiens; identical to SEQ ID NO: 535020
  misc_feature: HIJSMM301BMJQ8.18.9.A09.1.454.light.4.raw

SEQ ID NO: 565601 - DNA, 495 bp, Homo sapiens
  misc_feature: HIJSMM301AIQGE.16.53.E09.1.454.light.4.raw
tgtactactccacgaccggtgctcgatttagagagagtgtgttgggtttagggggacgtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtgg

SEQ ID NO: 565602 - DNA, 485 bp, Homo sapiens
  misc_feature: HIJSMM301DOSIG.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgagggtggaaagtcaaacgaactagtggctgcaccaat

SEQ ID NO: 565603 - DNA, 488 bp, Homo sapiens; identical to SEQ ID NO: 553834
  misc_feature: HIJSMM301DP73R.17.35.D02.1.454.light.4.raw

SEQ ID NO: 565604 - DNA, 485 bp, Homo sapiens
  misc_feature: HIJSMM301BZSCX.49.29.C07.1.454.light.4.raw
agtcgagagacacgaccggtgctcgatttagagtgctacgaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaa

SEQ ID NO: 565605 - DNA, 495 bp, Homo sapiens; identical to SEQ ID NO: 554164
  misc_feature: HIJSMM301AMDWP.27.78.H01.1.454.light.4.raw

SEQ ID NO: 565606 - DNA, 484 bp, Homo sapiens
  misc_feature: HIJSMM301B172T.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagtcaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 565607 - DNA, 509 bp, Homo sapiens
  misc_feature: HIJSMM301BDVS4.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgtcagctcatatgcaggcagcagcagtccccatgtgatcttcggcggggggaccaagctgaccgtcctaggtcagcccaaggctgtccccccg

SEQ ID NO: 565608 - DNA, 484 bp, Homo sapiens; identical to SEQ ID NO: 535441
  misc_feature: HIJSMM301EDT8D.26.60.F05.1.454.light.4.raw

SEQ ID NO: 565609 - DNA, 494 bp, Homo sapiens
  misc_feature: HIJSMM301ATNPS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatcaccttcggccaagggacacgactggagattaaacgaactgtggctgcaccatctgtcttcattcc

SEQ ID NO: 565610 - DNA, 524 bp, Homo sapiens
  misc_feature: HIJSMM301ALR6P.14.70.G04.1.454.light.4.raw
cgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaacggcccaacccccacctgtcactctccg

SEQ ID NO: 565611 - DNA, 487 bp, Homo sapiens
  misc_feature: HIJSMM301B0EB5.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcatagtgggtcccatctaggttcagtggcagtggatctgggacagatttcactctcaccatcagcagtctgcaacctgaagattttgcaacttactactgtcaacagagttacggtacccgtacacttttggccagggaccaaactggacatacaaacgaactgtggctgcaccatctgtt

SEQ ID NO: 565612 - DNA, 475 bp, Homo sapiens; identical to SEQ ID NO: 548160
  misc_feature: HIJSMM301AU97B.52.1.A01.1.454.light.4.raw

SEQ ID NO: 565613 - DNA, 488 bp, Homo sapiens; identical to SEQ ID NO: 535081
  misc_feature: HIJSMM301CLDI6.26.23.C01.1.454.light.4.raw

SEQ ID NO: 565614 - DNA, 486 bp, Homo sapiens; identical to SEQ ID NO: 535043
  misc_feature: HIJSMM301DURCN.46.35.D02.1.454.light.4.raw

SEQ ID NO: 565615 - DNA, 501 bp, Homo sapiens
  misc_feature: HIJSMM301D4N49.49.29.C07.1.454.light.4.raw
agtcgagagacacgaccggtgctcgatttagagtgctacgaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 565616 - DNA, 485 bp, Homo sapiens
  misc_feature: HIJSMM301DE4U4.40.36.D03.1.454.light.4.raw
tctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattatactactccgctcactttcggcggaggcaccaaggtggagatcagacgaa

SEQ ID NO: 565617 - DNA, 474 bp, Homo sapiens; identical to SEQ ID NO: 548202
  misc_feature: HIJSMM301EUZQL.3.1.A01.1.454.light.4.raw

SEQ ID NO: 565618 - DNA, 503 bp, Homo sapiens; identical to SEQ ID NO: 536313
  misc_feature: HIJSMM301DOHEF.21.22.B11.1.454.light.4.raw

SEQ ID NO: 565619 - DNA, 486 bp, Homo sapiens
  misc_feature: HIJSMM301B02F1.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccaagggaccaaggtggagaccaaacgaactgtggctgcaccat

SEQ ID NO: 565620 - DNA, 479 bp, Homo sapiens
  misc_feature: HIJSMM301A18UY.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctggccgtcctaagtcagacccg

SEQ ID NO: 565621 - DNA, 500 bp, Homo sapiens
  misc_feature: HIJSMM301BYSUV.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgagattttgcagtgtattattgtcagcagtatggtagcgcaccgtacacttttggccaggggtccaagctggagatgaaacgaactgtggctgcaccatctgtcttcatcttccccg

SEQ ID NO: 565622 - DNA, 505 bp, Homo sapiens; identical to SEQ ID NO: 535503
  misc_feature: HIJSMM301BNGF8.8.28.C06.1.454.light.4.raw

SEQ ID NO: 565623 - DNA, 515 bp, Homo sapiens
  misc_feature: HIJSMM301D5810.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccacctcctccgt

SEQ ID NO: 565624 - DNA, 475 bp, Homo sapiens
  misc_feature: HIJSMM301E0OV3.49.4.A04.1.454.light.4.raw
agtcgagagacacgaccggtgctcgatttagagtagtgatcagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggtcgggggaccggaacgtaggtgagtcaagcgaactgtggctg

SEQ ID NO: 565625 - DNA, 508 bp, Homo sapiens
  misc_feature: HIJSMM301BVCZW.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccacttcggccctgggaccaaacttgagatcaaacgaactgtggctgcaccatctgtcttctat

SEQ ID NO: 565626 - DNA, 507 bp, Homo sapiens
  misc_feature: HIJSMM301CH6TU.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactccg

SEQ ID NO: 565627 - DNA, 490 bp, Homo sapiens; identical to SEQ ID NO: 535420
  misc_feature: HIJSMM301A8IN6.3.72.G06.1.454.light.4.raw

SEQ ID NO: 565628 - DNA, 467 bp, Homo sapiens
  misc_feature: HIJSMM301BH6V6.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtttgataatctcctctcactttcacgtcggagggaccaaggtggagatcaaacgaa

SEQ ID NO: 565629 - DNA, 496 bp, Homo sapiens; identical to SEQ ID NO: 536690
  misc_feature: HIJSMM301EIDD1.40.23.C01.1.454.light.4.raw

SEQ ID NO: 565630 - DNA, 492 bp, Homo sapiens
  misc_feature: HIJSMM301A4Z8B.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggaggatcagacgaactagtggctgcaccatctgtcttcta

SEQ ID NO: 565631 - DNA, 503 bp, Homo sapiens
  misc_feature: HIJSMM301BZUU2.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcac

SEQ ID NO: 565632 - DNA, 493 bp, Homo sapiens; identical to SEQ ID NO: 535084
  misc_feature: HIJSMM301DIBR1.47.64.F09.1.454.light.4.raw

SEQ ID NO: 565633 - DNA, 494 bp, Homo sapiens
  misc_feature: HIJSMM301EBMFL.9.1.A01.1.454.light.4.raw
  modified_base (481)..(481): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtnttcatcttccccg

SEQ ID NO: 565634 - DNA, 505 bp, Homo sapiens
  misc_feature: HIJSMM301BX0C9.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggcccgtgggaccaagtggatatcaaacgaactgtggctgcaccatctgtt

SEQ ID NO: 565635 - DNA, 509 bp, Homo sapiens; identical to SEQ ID NO: 547302
  misc_feature: HIJSMM301EZ3Z1.4.57.F02.1.454.light.4.raw

SEQ ID NO: 565636 - DNA, 514 bp, Homo sapiens; identical to SEQ ID NO: 538153
  misc_feature: HIJSMM301BPJMF.17.37.D04.1.454.light.4.raw

SEQ ID NO: 565637 - DNA, 495 bp, Homo sapiens
  misc_feature: HIJSMM301ALCZZ.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcgggtaccgacgaggtggagtgtcaacgaactagt

SEQ ID NO: 565638 - DNA, 445 bp, Homo sapiens; identical to SEQ ID NO: 537719
  misc_feature: HIJSMM301E2D9N.47.85.H08.1.454.light.4.raw

SEQ ID NO: 565639 - DNA, 487 bp, Homo sapiens
  misc_feature: HIJSMM301EHIIT.52.22.B11.1.454.light.4.raw
cgcagtacgacacgaccggtgctcgatttagacgacagctcaggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaaggtggagatcaaacgaactgtggctgcaccatctgtcttcattccc

SEQ ID NO: 565640 - DNA, 502 bp, Homo sapiens; identical to SEQ ID NO: 554122
  misc_feature: HIJSMM301D9QLC.2.35.D02.1.454.light.4.raw

SEQ ID NO: 565641 - DNA, 463 bp, Homo sapiens
  misc_feature: HIJSMM301AKY59.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgtgacagactttactctcaccatcagcagcctgcagcctgaagatattgcaacatattactgtcaacagtatgatcgtctcctcaatttcggccctgggaccagagtggacatgaaacgaa

SEQ ID NO: 565642 - DNA, 463 bp, Homo sapiens; identical to SEQ ID NO: 545937
  misc_feature: HIJSMM301EM38K.17.28.C06.1.454.light.4.raw

SEQ ID NO: 565643 - DNA, 493 bp, Homo sapiens
  misc_feature: HIJSMM301CATTD.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagatagtactttacctcggaccttcggccaagggacacgactggagattaaacgaactgtggctgca

SEQ ID NO: 565644 - DNA, 488 bp, Homo sapiens
  misc_feature: HIJSMM301EXQJ0.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaattttattactgtatgcaaggtatagagcttcctccgacgttcggccaagggaccaaggtggaactcaaacgaa

SEQ ID NO: 565645 - DNA, 492 bp, Homo sapiens; identical to SEQ ID NO: 536010
  misc_feature: HIJSMM301A6DSB.10.20.B09.1.454.light.4.raw

SEQ ID NO: 565646 - DNA, 507 bp, Homo sapiens
  misc_feature: HIJSMM301CHTTR.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggagccggccccccgactcctcattctttaataacaatcagcggccctcaggggtccctgaccgattctctggctccaagtctggcacctcagcctccctggccatcagtgggctccagtctgaggatgaggctgattattactgtgcatcatgggctgacaccctgactgggtccgggagttgttcgggcggagggaccaagctgaccgtcctaggtcagcccaa

SEQ ID NO: 565647 - DNA, 499 bp, Homo sapiens; identical to SEQ ID NO: 543887
  misc_feature: HIJSMM301B8YY8.10.65.F10.1.454.light.4.raw

SEQ ID NO: 565648 - DNA, 505 bp, Homo sapiens; identical to SEQ ID NO: 552306
  misc_feature: HIJSMM301D9DGB.48.16.B05.1.454.light.4.raw

SEQ ID NO: 565649 - DNA, 497 bp, Homo sapiens; identical to SEQ ID NO: 536376
  misc_feature: HIJSMM301BSXIL.22.9.A09.1.454.light.4.raw

SEQ ID NO: 565650 - DNA, 489 bp, Homo sapiens
  misc_feature: HIJSMM301A4FY4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctttca

SEQ ID NO: 565651 - DNA, 505 bp, Homo sapiens; identical to SEQ ID NO: 535503
  misc_feature: HIJSMM301CWPSV.8.28.C06.1.454.light.4.raw

SEQ ID NO: 565652 - DNA, 478 bp, Homo sapiens
  misc_feature: HIJSMM301B3LE7.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagattttcactctcaccatcagcagtctgcaacctgaagattctgcaacttattactgtcaacagagtaacagttaccctcccactttcggcggagggaccaaggtggagatcaaacgaactgtggctgcaccatctgtt

SEQ ID NO: 565653 - DNA, 500 bp, Homo sapiens
  misc_feature: HIJSMM301EG1FS.4.39.D06.1.454.light.4.raw
  modified_base (455)..(455): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggnggagggaccaaatgaccgtctaggtcagcccaaggctgccccctc

SEQ ID NO: 565654 - DNA, 502 bp, Homo sapiens; identical to SEQ ID NO: 539002
  misc_feature: HIJSMM301BFK8O.18.59.F04.1.454.light.4.raw

SEQ ID NO: 565655 - DNA, 507 bp, Homo sapiens
  misc_feature: HIJSMM301EC3HR.18.78.H01.1.454.light.4.raw
tacgagtatgcacgaccggtgctcgatttagtgtgagtagtttgggtttggggggggtctcaggaggcagcactctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 565656 - DNA, 517 bp, Homo sapiens
  misc_feature: HIJSMM301DPA9L.51.27.C05.1.454.light.4.raw
cgatcgtatacacgaccggtgctcgatttagacgcgatcgaagggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 565657 - DNA, 487 bp, Homo sapiens; identical to SEQ ID NO: 537220
  misc_feature: HIJSMM301C6NEH.16.53.E09.1.454.light.4.raw

SEQ ID NO: 565658 - DNA, 491 bp, Homo sapiens
  misc_feature: HIJSMM301EZO7Z.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactctccgaggctcactttcggcggagggaccaaggtggaggatcaaacgaa

SEQ ID NO: 565659 - DNA, 494 bp, Homo sapiens; identical to SEQ ID NO: 538747
  misc_feature: HIJSMM301C4139.22.86.H09.1.454.light.4.raw

SEQ ID NO: 565660 - DNA, 493 bp, Homo sapiens; identical to SEQ ID NO: 535047
  misc_feature: HIJSMM301D6THQ.16.53.E09.1.454.light.4.raw

SEQ ID NO: 565661 - DNA, 478 bp, Homo sapiens
  misc_feature: HIJSMM301BM4KF.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcggacc

SEQ ID NO: 565662 - DNA, 487 bp, Homo sapiens; identical to SEQ ID NO: 537573
  misc_feature: HIJSMM301AYKWD.3.10.A10.1.454.light.4.raw

SEQ ID NO: 565663 - DNA, 513 bp, Homo sapiens; identical to SEQ ID NO: 546362
  misc_feature: HIJSMM301AS7DS.16.66.F11.1.454.light.4.raw

SEQ ID NO: 565664 - DNA, 447 bp, Homo sapiens; identical to SEQ ID NO: 535020
  misc_feature: HIJSMM301AUV54.18.9.A09.1.454.light.4.raw

SEQ ID NO: 565665 - DNA, 495 bp, Homo sapiens
  misc_feature: HIJSMM301EWMZS.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagtcaaacgaactagtggctgcaccatctgtcttcat

SEQ ID NO: 565666 - DNA, 488 bp, Homo sapiens
  misc_feature: HIJSMM301BW7AR.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaacgaactgtggctgcacca

SEQ ID NO: 565667 - DNA, 489 bp, Homo sapiens
  misc_feature: HIJSMM301DQ1N2.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctcgagcgattcagtggcagcgggtctgggacagatttcactctcaccatcagcagcctgcaggctgaagatgtggcagtttattactgtcagcaatattctactactcctcggactttcggcggagggaccgaaggtggaggatcaaacgaa

SEQ ID NO: 565668 - DNA, 480 bp, Homo sapiens; identical to SEQ ID NO: 551245
  misc_feature: HIJSMM301D5X40.21.25.C03.1.454.light.4.raw

SEQ ID NO: 565669 - DNA, 494 bp, Homo sapiens; identical to SEQ ID NO: 536974
  misc_feature: HIJSMM301EVNEZ.16.86.H09.1.454.light.4.raw

SEQ ID NO: 565670 - DNA, 497 bp, Homo sapiens
  misc_feature: HIJSMM301BRMDD.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 565671 - DNA, 489 bp, Homo sapiens; identical to SEQ ID NO: 542780
  misc_feature: HIJSMM301BS3K2.16.53.E09.1.454.light.4.raw

SEQ ID NO: 565672 - DNA, 507 bp, Homo sapiens
  misc_feature: HIJSMM301B9Y6A.8.28.C06.1.454.light.4.raw
ctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcta

SEQ ID NO: 565673 - DNA, 503 bp, Homo sapiens; identical to SEQ ID NO: 538884
  misc_feature: HIJSMM301EJ0LL.27.78.H01.1.454.light.4.raw

SEQ ID NO: 565674 - DNA, 506 bp, Homo sapiens
  misc_feature: HIJSMM301BK9FP.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccacgtttcggccctcgggaccaaagtggatatcaaacgaactgtggctgcaccatctgtt

SEQ ID NO: 565675 - DNA, 490 bp, Homo sapiens; identical to SEQ ID NO: 535234
  misc_feature: HIJSMM301AKVFC.17.21.B10.1.454.light.4.raw

SEQ ID NO: 565676 - DNA, 497 bp, Homo sapiens
  misc_feature: HIJSMM301BWWM8.49.19.B08.1.454.light.4.raw
agtcgagagacacgaccggtgctcgatttagtgagtcagtaaggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcaactccaacattgggaagaattatgtatcgtggtaccagcagttcccaggaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcacgg

SEQ ID NO: 565677 - DNA, 494 bp, Homo sapiens; identical to SEQ ID NO: 534994
  misc_feature: HIJSMM301CUBX7.27.78.H01.1.454.light.4.raw

SEQ ID NO: 565678 - DNA, 496 bp, Homo sapiens
  misc_feature: HIJSMM301BVVIB.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactatgttcccaccctcctcgagtgcgtct

SEQ ID NO: 565679 - DNA, 487 bp, Homo sapiens
  misc_feature: HIJSMM301B7W25.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgtcgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagataacgaactgtggctgcaccatctgtcttcat

SEQ ID NO: 565680 - DNA, 508 bp, Homo sapiens
  misc_feature: HIJSMM301AXB3A.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaaggtggagatcaaacgaactgtggctgcaccatctgtt

SEQ ID NO: 565681 - DNA, 510 bp, Homo sapiens
  misc_feature: HIJSMM301AY1PX.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttgggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 565682 - DNA, 496 bp, Homo sapiens
  misc_feature: HIJSMM301CUSE7.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtgctgcacatctgtcttcatcttccccg

SEQ ID NO: 565683 - DNA, 489 bp, Homo sapiens
  misc_feature: HIJSMM301BOV67.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgccaggttcagtgccagtgggtctgggacagagttcactctcaccatcagcagcctgcagtctgaagattttgctactttattactgtcagcaatataatgactggttctcgatcaccttcggccaagggacacgactggagattaaacgaactgtggctgcaccatctgtt

SEQ ID NO: 565684 - DNA, 484 bp, Homo sapiens
  misc_feature: HIJSMM301BBQYA.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcacccaatttggaatcaggggtcccatcaaggttcagtggaagtggatctgggacagattttactttcaccatcaccagcctgcagcctgaagatattgcaacatattactgtcaacagtatgataatctccctccctactttcggcggagggaccaaggtggagatcaaacgaactgtggctgcaccat

SEQ ID NO: 565685 - DNA, 494 bp, Homo sapiens; identical to SEQ ID NO: 535629
  misc_feature: HIJSMM301CAJK5.4.27.C05.1.454.light.4.raw

SEQ ID NO: 565686 - DNA, 501 bp, Homo sapiens
  misc_feature: HIJSMM301CMRLW.48.57.F02.1.454.light.4.raw
agtatacatacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaaggctgaccgtcctaggtcagcccaaggctgccccctc

SEQ ID NO: 565687 - DNA, 441 bp, Homo sapiens; identical to SEQ ID NO: 534971
  misc_feature: HIJSMM301C4JWF.11.3.A03.1.454.light.4.raw

SEQ ID NO: 565688 - DNA, 497 bp, Homo sapiens; identical to SEQ ID NO: 538296
  misc_feature: HIJSMM301AMO39.18.11.A11.1.454.light.4.raw

SEQ ID NO: 565689 - DNA, 510 bp, Homo sapiens
  misc_feature: HIJSMM301A7JJG.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagacgaactacgtggcgtgcgccactctgtcttctatcttcccgt

SEQ ID NO: 565690 - DNA, 486 bp, Homo sapiens
  misc_feature: HIJSMM301C8JSR.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctcgttcccaccctcctctacgtgagct

SEQ ID NO: 565691 - DNA, 377 bp, Homo sapiens; identical to SEQ ID NO: 536071
  misc_feature: HIJSMM301BLRI1.40.9.A09.1.454.light.4.raw

SEQ ID NO: 565692 - DNA, 506 bp, Homo sapiens
  misc_feature: HIJSMM301D9G2W.3.37.D04.1.454.light.4.raw
agacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataattggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaacccactgtcact

SEQ ID NO: 565693 - DNA, 488 bp, Homo sapiens
  misc_feature: HIJSMM301DULW2.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccctcacctttcggcggagggaccaaggcggagatcagacgaactgtggctgcaccatctgtcttca

SEQ ID NO: 565694 - DNA, 508 bp, Homo sapiens; identical to SEQ ID NO: 564177
  misc_feature: HIJSMM301A20CZ.17.28.C06.1.454.light.4.raw

SEQ ID NO: 565695 - DNA, 505 bp, Homo sapiens; identical to SEQ ID NO: 551816
  misc_feature: HIJSMM301AVDVA.18.78.H01.1.454.light.4.raw

SEQ ID NO: 565696 - DNA, 505 bp, Homo sapiens; identical to SEQ ID NO: 535987
  misc_feature: HIJSMM301DY88J.18.37.D04.1.454.light.4.raw

SEQ ID NO: 565697 - DNA, 486 bp, Homo sapiens
  misc_feature: HIJSMM301DKPHF.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttccgtggcagtggatcaggcacagattttacattgaaaatcagcagagtggaggctgaggatgttgggctctattattgcatgcaagctctacaagtcccgctcactttcggcggagggaccaaggtggagatcaaacgaact

SEQ ID NO: 565698 - DNA, 492 bp, Homo sapiens
  misc_feature: HIJSMM301CUCWC.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 565699 - DNA, 479 bp, Homo sapiens; identical to SEQ ID NO: 538734
  misc_feature: HIJSMM301A19RU.8.53.E09.1.454.light.4.raw

SEQ ID NO: 565700 - DNA, 491 bp, Homo sapiens; identical to SEQ ID NO: 535194
  misc_feature: HIJSMM301ER4KE.26.78.H01.1.454.light.4.raw

SEQ ID NO: 565701 - DNA, 499 bp, Homo sapiens; identical to SEQ ID NO: 543887
  misc_feature: HIJSMM301EGUXK.10.65.F10.1.454.light.4.raw

SEQ ID NO: 565702 - DNA, 494 bp, Homo sapiens; identical to SEQ ID NO: 534992
  misc_feature: HIJSMM301C9OYX.9.1.A01.1.454.light.4.raw

SEQ ID NO: 565703 - DNA, 502 bp, Homo sapiens
  misc_feature: HIJSMM301DKIY7.48.47.E03.1.454.light.4.raw
agtatacatacacgaccggtgctcgatttagactcgcgcacagagagagggggagagaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcta

SEQ ID NO: 565704 - DNA, 524 bp, Homo sapiens
  misc_feature: HIJSMM301BO1LT.41.35.D02.1.454.light.4.raw
tctatactatcacgaccggtgctcgatttagcacacgatagttgggtttggggggggtcacaagaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 565705 - DNA, 488 bp, Homo sapiens; identical to SEQ ID NO: 541868
  misc_feature: HIJSMM301CLAL5.14.55.E11.1.454.light.4.raw

SEQ ID NO: 565706 - DNA, 485 bp, Homo sapiens; identical to SEQ ID NO: 535880
  misc_feature: HIJSMM301EXZY0.7.75.G09.1.454.light.4.raw

SEQ ID NO: 565707 - DNA, 486 bp, Homo sapiens; identical to SEQ ID NO: 544919
  misc_feature: HIJSMM301EWGLN.7.85.H08.1.454.light.4.raw

SEQ ID NO: 565708 - DNA, 495 bp, Homo sapiens
  misc_feature: HIJSMM301D0FTA.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggaggatacaaacgaaaccta

SEQ ID NO: 565709 - DNA, 444 bp, Homo sapiens; identical to SEQ ID NO: 552512
  misc_feature: HIJSMM301AHTR5.5.9.A09.1.454.light.4.raw

SEQ ID NO: 565710 - DNA, 485 bp, Homo sapiens; identical to SEQ ID NO: 536263
  misc_feature: HIJSMM301C7SDJ.47.78.H01.1.454.light.4.raw

SEQ ID NO: 565711 - DNA, 500 bp, Homo sapiens
  misc_feature: HIJSMM301EQD5Z.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccccg

SEQ ID NO: 565712 - DNA, 479 bp, Homo sapiens
  misc_feature: HIJSMM301DYL47.14.53.E09.1.454.light.4.raw
  modified_base (461)..(461): a, c, t, g, unknown or other
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattctatcgggtgttcggngaggaccaagctgaccgt

SEQ ID NO: 565713 - DNA, 491 bp, Homo sapiens
  misc_feature: HIJSMM301DRH0G.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtc

SEQ ID NO: 565714 - DNA, 513 bp, Homo sapiens
  misc_feature: HIJSMM301DRSBL.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccaccctcctcga

SEQ ID NO: 565715 - DNA, 488 bp, Homo sapiens; identical to SEQ ID NO: 541295
  misc_feature: HIJSMM301D79WD.9.59.F04.1.454.light.4.raw

SEQ ID NO: 565716 - DNA, 389 bp, Homo sapiens
  misc_feature: HIJSMM301B33TA.43.10.A10.1.454.light.4.raw
tgtgagtagtcacgaccggtgctcgatttagcgtcgatctcaggggagagctctggggagtctgcaccatggcttggaccccactcctcttcctcaccctcctcctccactgcacagggtctctctcccagcttgtggtgatttaatcgccctctgcctctgcctccctgagacctcggtcaaactcacctgcactctgaacagtgggcacagcagctacggcatcgcacggcatcaccaccggccagagaagggccctcggttcttgatgaagtttagcagtgatggcaatcgcatcatgggggacggaatccctgatcgcttctcaggctccaggtcagcccaaggctgccccctggtcactctgttcccgccctcctcactctaca

SEQ ID NO: 565717 - DNA, 497 bp, Homo sapiens; identical to SEQ ID NO: 535286
  misc_feature: HIJSMM301B22UB.18.59.F04.1.454.light.4.raw

SEQ ID NO: 565718 - DNA, 510 bp, Homo sapiens
  misc_feature: HIJSMM301B7EJ9.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacctttccggcccgtcgggaccaaagtggatatcaaacgaactgtggctgcaccatctgtctt

SEQ ID NO: 565719 - DNA, 490 bp, Homo sapiens
  misc_feature: HIJSMM301EW2EY.16.73.G07.1.454.light.4.raw
tgtactactccacgaccggtgctcgatttagctctacgctcgggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcc

SEQ ID NO: 565720 - DNA, 495 bp, Homo sapiens; identical to SEQ ID NO: 538359
  misc_feature: HIJSMM301AMN2L.11.59.F04.1.454.light.4.raw

SEQ ID NO: 565721 - DNA, 495 bp, Homo sapiens
  misc_feature: HIJSMM301BCX9W.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaaggctggagatcaaccgaactgtggctgcaccatctgtt

SEQ ID NO: 565722 - DNA, 485 bp, Homo sapiens; identical to SEQ ID NO: 536075
  misc_feature: HIJSMM301C81K2.17.21.B10.1.454.light.4.raw

SEQ ID NO: 565723 - DNA, 479 bp, Homo sapiens; identical to SEQ ID NO: 535188
  misc_feature: HIJSMM301CA8V9.10.74.G08.1.454.light.4.raw

SEQ ID NO: 565724 - DNA, 489 bp, Homo sapiens; identical to SEQ ID NO: 535139
  misc_feature: HIJSMM301AK3PP.14.55.E11.1.454.light.4.raw

SEQ ID NO: 565725 - DNA, 459 bp, Homo sapiens
  misc_feature: HIJSMM301ERRK5.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggtttcggcggagggaccaagctgaccgtcctaggtcagcccaaggctgccccctcggtcactctgttcccaccctcctcgtatctctcg

SEQ ID NO: 565726 - DNA, 505 bp, Homo sapiens; identical to SEQ ID NO: 535987
  misc_feature: HIJSMM301BG2UG.18.37.D04.1.454.light.4.raw

SEQ ID NO: 565727 - DNA, 433 bp, Homo sapiens; identical to SEQ ID NO: 535337
  misc_feature: HIJSMM301BB3OX.18.5.A05.1.454.light.4.raw

SEQ ID NO: 565728 - DNA, 506 bp, Homo sapiens
  misc_feature: HIJSMM301DQ4WG.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggcccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtcg

SEQ ID NO: 565729 - DNA, 494 bp, Homo sapiens; identical to SEQ ID NO: 534994
  misc_feature: HIJSMM301B9518.27.78.H01.1.454.light.4.raw

SEQ ID NO: 565730 - DNA, 486 bp, Homo sapiens
  misc_feature: HIJSMM301DMYUT.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacggactggagattaaacgaactgtggctgcaccatctgt

SEQ ID NO: 565731 - DNA, 497 bp, Homo sapiens
  misc_feature: HIJSMM301CBK2S.52.55.E11.1.454.light.4.raw
cgcagtacgacacgaccggtgctcgatttagcactcgcacgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaacgaactgtggctgcaccatctgtcttcat

SEQ ID NO: 565732 - DNA, 507 bp, Homo sapiens
  misc_feature: HIJSMM301CWWJH.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcatt

SEQ ID NO: 565733 - DNA, 500 bp, Homo sapiens
  misc_feature: HIJSMM301B21ST.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaacgaactgtggctgcacatctgtcttcatcttcccg

SEQ ID NO: 565734 - DNA, 447 bp, Homo sapiens; identical to SEQ ID NO: 535201
  misc_feature: HIJSMM301CFZTT.18.9.A09.1.454.light.4.raw

SEQ ID NO: 565735 - DNA, 521 bp, Homo sapiens; identical to SEQ ID NO: 538715
  misc_feature: HIJSMM301A8EB7.27.23.C01.1.454.light.4.raw

SEQ ID NO: 565736 - DNA, 471 bp, Homo sapiens
  misc_feature: HIJSMM301BB0ML.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtggagatcaaacgaa

SEQ ID NO: 565737 - DNA, 472 bp, Homo sapiens
  misc_feature: HIJSMM301BGYGN.51.34.D01.1.454.light.4.raw
cgatcgtatacacgaccggtgctcgatttagatcgtctgtgttgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagatcaagcgaa

SEQ ID NO: 565738 - DNA, 490 bp, Homo sapiens
  misc_feature: HIJSMM301DCX4S.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtggatctggcacagatttcactctcaccatcagcagcctgcagcctgaagatttcgcaacttattactgtctacaagattacaattaccctcggacgttcgtccagggaccgaacggtggaaagtcaaacgaactacgtggctgcacca

SEQ ID NO: 565739 - DNA, 501 bp, Homo sapiens
  misc_feature: HIJSMM301AM6YH.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcact

SEQ ID NO: 565740 - DNA, 487 bp, Homo sapiens; identical to SEQ ID NO: 538190
  misc_feature: HIJSMM301EECFJ.47.70.G04.1.454.light.4.raw

SEQ ID NO: 565741 - DNA, 487 bp, Homo sapiens
  misc_feature: HIJSMM301DYEH3.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaagtggagatacaacgaactgtggctgcacca

SEQ ID NO: 565742 - DNA, 505 bp, Homo sapiens; identical to SEQ ID NO: 539292
  misc_feature: HIJSMM301A274V.19.85.H08.1.454.light.4.raw

SEQ ID NO: 565743 - DNA, 505 bp, Homo sapiens
  misc_feature: HIJSMM301DCYHH.48.34.D01.1.454.light.4.raw
agtatacatacacgaccggtgctcgatttagatcgtctgtgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 565744 - DNA, 487 bp, Homo sapiens
  misc_feature: HIJSMM301BDGTQ.49.76.G10.1.454.light.4.raw
agtcgagagacacgaccggtgctcgatttagtcactcatacagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggctcctgatctatgctgcatccaatttgcaaagtggggtcccatcaaggttcagtgccagtggatctgggacagacttcaccctcaccatcgacagtctgcaacctgaagattttgcaacttacttctgtcaacagagtttcgcttccccctacacttttggccaggggaccaagctggcgatcaaacgaactgtggctgcaccatctgtcttcta

SEQ ID NO: 565745 - DNA, 447 bp, Homo sapiens; identical to SEQ ID NO: 535201
  misc_feature: HIJSMM301CZB5T.18.9.A09.1.454.light.4.raw

SEQ ID NO: 565746 - DNA, 489 bp, Homo sapiens
  misc_feature: HIJSMM301AV5BM.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccgaaggtggaggatcaaacgaaactgtggctgcaccatctgtctt

SEQ ID NO: 565747 - DNA, 506 bp, Homo sapiens
  misc_feature: HIJSMM301CPLNC.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccaagacagattcagcggcagtgggtcaggcactgatttcacactggaaatcagcagggtggaggctgaggatgttggggtttattactgcatgcaaactacacacggccgctcactttcggcggaggaccgaaggtggagatcaaacgaactgtggctgcaccatctgt

SEQ ID NO: 565748 - DNA, 492 bp, Homo sapiens; identical to SEQ ID NO: 535126
  misc_feature: HIJSMM301AME6E.18.11.A11.1.454.light.4.raw

SEQ ID NO: 565749 - DNA, 500 bp, Homo sapiens
  misc_feature: HIJSMM301BFGK8.26.26.C04.1.454.light.4.raw
agactatactcacgaccggtgctcgatttagtctagcgactttgggtttgggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttggccaagggaccgaacggtggaaagtacaaacgaaactgtggctgcac

SEQ ID NO: 565750 - DNA, 464 bp, Homo sapiens; identical to SEQ ID NO: 536640
  misc_feature: HIJSMM301AGP5C.26.78.H01.1.454.light.4.raw

SEQ ID NO: 565751 - DNA, 488 bp, Homo sapiens; identical to SEQ ID NO: 540342
  misc_feature: HIJSMM301C4EWV.43.33.C11.1.454.light.4.raw

SEQ ID NO: 565752 - DNA, 494 bp, Homo sapiens; identical to SEQ ID NO: 534992
  misc_feature: HIJSMM301AHZX1.9.1.A01.1.454.light.4.raw

SEQ ID NO: 565753 - DNA, 446 bp, Homo sapiens
  misc_feature: HIJSMM301C1NMZ.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcgattaatgataacaacaatcggccctcaggggtctctgaccgattctctgcctccaagtctaggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 565754 - DNA, 502 bp, Homo sapiens; identical to SEQ ID NO: 537363
  misc_feature: HIJSMM301EHKEM.18.23.C01.1.454.light.4.raw

SEQ ID NO: 565755 - DNA, 489 bp, Homo sapiens; identical to SEQ ID NO: 543840
  misc_feature: HIJSMM301BOGVK.12.88.H11.1.454.light.4.raw

SEQ ID NO: 565756 - DNA, 487 bp, Homo sapiens; identical to SEQ ID NO: 535069
  misc_feature: HIJSMM301EHWVA.26.23.C01.1.454.light.4.raw

SEQ ID NO: 565757 - DNA, 513 bp, Homo sapiens; identical to SEQ ID NO: 547639
  misc_feature: HIJSMM301DAO4T.43.59.F04.1.454.light.4.raw

SEQ ID NO: 565758 - DNA, 501 bp, Homo sapiens
  misc_feature: HIJSMM301ER5ZM.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccta

SEQ ID NO: 565759 - DNA, 502 bp, Homo sapiens; identical to SEQ ID NO: 536253
  misc_feature: HIJSMM301D5L8W.21.22.B11.1.454.light.4.raw

SEQ ID NO: 565760 - DNA, 496 bp, Homo sapiens; identical to SEQ ID NO: 537513
  misc_feature: HIJSMM301DXQSS.12.87.H10.1.454.light.4.raw

SEQ ID NO: 565761 - DNA, 444 bp, Homo sapiens; identical to SEQ ID NO: 534993
  misc_feature: HIJSMM301APZCS.5.9.A09.1.454.light.4.raw

SEQ ID NO: 565762 - DNA, 503 bp, Homo sapiens
  misc_feature: HIJSMM301AD22W.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcaacagcctgcagtctgaagattttgcagtttattactgtcagcagtataataactggcctccggtcacttcggtcggagggaccgaaggtaggaggagtacaaacgaaactagtggcgtgcaccactctgtt

SEQ ID NO: 565763 - DNA, 500 bp, Homo sapiens
  misc_feature: HIJSMM301EL1OT.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctctctcacgttcggcggagggaccaaggtggagatcaaacgaactgtggctgcaccatctgtctt

SEQ ID NO: 565764 - DNA, 494 bp, Homo sapiens; identical to SEQ ID NO: 535276
  misc_feature: HIJSMM301AUEGC.16.6.A06.1.454.light.4.raw

SEQ ID NO: 565765 - DNA, 496 bp, Homo sapiens; identical to SEQ ID NO: 535541
  misc_feature: HIJSMM301AOWE7.3.33.C11.1.454.light.4.raw

SEQ ID NO: 565766 - DNA, 507 bp, Homo sapiens
  misc_feature: HIJSMM301CRUOH.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctggtcactctgttcccta

SEQ ID NO: 565767 - DNA, 494 bp, Homo sapiens; identical to SEQ ID NO: 534994
  misc_feature: HIJSMM301A69RO.27.78.H01.1.454.light.4.raw

SEQ ID NO: 565768 - DNA, 447 bp, Homo sapiens; identical to SEQ ID NO: 535201
  misc_feature: HIJSMM301B9WCT.18.9.A09.1.454.light.4.raw

SEQ ID NO: 565769 - DNA, 496 bp, Homo sapiens
  misc_feature: HIJSMM301AILWM.27.78.H01.1.454.light.4.raw
  modified_base (483)..(483): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagaattaaacgaaactgtggcgtncaccatctgtctt

SEQ ID NO: 565770 - DNA, 490 bp, Homo sapiens; identical to SEQ ID NO: 534991
  misc_feature: HIJSMM301B3A6U.48.75.G09.1.454.light.4.raw

SEQ ID NO: 565771 - DNA, 506 bp, Homo sapiens; identical to SEQ ID NO: 539705
  misc_feature: HIJSMM301AD7JQ.40.67.G01.1.454.light.4.raw

SEQ ID NO: 565772 - DNA, 493 bp, Homo sapiens; identical to SEQ ID NO: 536769
  misc_feature: HIJSMM301AMZZA.19.83.H06.1.454.light.4.raw

SEQ ID NO: 565773 - DNA, 496 bp, Homo sapiens; identical to SEQ ID NO: 535109
  misc_feature: HIJSMM301CSJ0Q.16.78.H01.1.454.light.4.raw

SEQ ID NO: 565774 - DNA, 486 bp, Homo sapiens; identical to SEQ ID NO: 535043
  misc_feature: HIJSMM301A075D.46.35.D02.1.454.light.4.raw

SEQ ID NO: 565775 - DNA, 521 bp, Homo sapiens; identical to SEQ ID NO: 539470
  misc_feature: HIJSMM301BH5ZQ.27.23.C01.1.454.light.4.raw

SEQ ID NO: 565776 - DNA, 487 bp, Homo sapiens; identical to SEQ ID NO: 537573
  misc_feature: HIJSMM301D5UXB.3.10.A10.1.454.light.4.raw

SEQ ID NO: 565777 - DNA, 489 bp, Homo sapiens
  misc_feature: HIJSMM301A8QT9.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggaggatcaaacgaa

SEQ ID NO: 565778 - DNA, 503 bp, Homo sapiens; identical to SEQ ID NO: 547740
  misc_feature: HIJSMM301CO1AA.48.67.G01.1.454.light.4.raw

SEQ ID NO: 565779 - DNA, 483 bp, Homo sapiens
  misc_feature: HIJSMM301CWWBM.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgttgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcaccatctgt

SEQ ID NO: 565780 - DNA, 489 bp, Homo sapiens; identical to SEQ ID NO: 544280
  misc_feature: HIJSMM301EHK2E.4.27.C05.1.454.light.4.raw

SEQ ID NO: 565781 - DNA, 488 bp, Homo sapiens; identical to SEQ ID NO: 535081
  misc_feature: HIJSMM301EFGVS.26.23.C01.1.454.light.4.raw

SEQ ID NO: 565782 - DNA, 496 bp, Homo sapiens; identical to SEQ ID NO: 551939
  misc_feature: HIJSMM301DQI0E.19.71.G05.1.454.light.4.raw

SEQ ID NO: 565783 - DNA, 515 bp, Homo sapiens
  misc_feature: HIJSMM301ERJ94.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagccaaggctgccccctcggtcactctgttcccaccctcctcg

SEQ ID NO: 565784 - DNA, 495 bp, Homo sapiens
  misc_feature: HIJSMM301BGIRE.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcgggccaagggacacgactggagattaaacgaactgtggctgcaccatctgtctt

SEQ ID NO: 565785 - DNA, 521 bp, Homo sapiens; identical to SEQ ID NO: 539470
  misc_feature: HIJSMM301APPNB.27.23.C01.1.454.light.4.raw

SEQ ID NO: 565786 - DNA, 517 bp, Homo sapiens
  misc_feature: HIJSMM301D2A17.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccccagaccctggagcctcagttggaagcagccgatccagcctgcggagcctgtgggcaggtcagcccaaggccaacccactgtcactctcg

SEQ ID NO: 565787 - DNA, 501 bp, Homo sapiens; identical to SEQ ID NO: 539652
  misc_feature: HIJSMM301AIRT4.9.71.G05.1.454.light.4.raw

SEQ ID NO: 565788 - DNA, 485 bp, Homo sapiens
  misc_feature: HIJSMM301CGIBC.22.29.C07.1.454.light.4.raw
  modified_base (474)..(474): a, c, t, g, unknown or other
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtgtcacgacgacgagaggtacgacgaacgatagtgtgcncactctgtctt

SEQ ID NO: 565789 - DNA, 510 bp, Homo sapiens
  misc_feature: HIJSMM301B15YV.11.57.F02.1.454.light.4.raw
cgagagataccacgaccggtgctcgatttagctcgatatagttgggtttgggggaggaactgctcagttaggacccagagggaaccacggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 565790 - DNA, 490 bp, Homo sapiens; identical to SEQ ID NO: 541244
  misc_feature: HIJSMM301CIFFH.41.44.D11.1.454.light.4.raw

SEQ ID NO: 565791 - DNA, 506 bp, Homo sapiens
  misc_feature: HIJSMM301CCT9X.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtctacc

SEQ ID NO: 565792 - DNA, 501 bp, Homo sapiens
  misc_feature: HIJSMM301D8PJL.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaacgaactgtggctgcaccatctgtcttcatcttcccgcc

SEQ ID NO: 565793 - DNA, 503 bp, Homo sapiens
  misc_feature: HIJSMM301AM4TW.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggctgccccctcggtca

SEQ ID NO: 565794 - DNA, 482 bp, Homo sapiens
  misc_feature: HIJSMM301BOK5C.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccacttcggtcggagggaccgaaggtaggagatacaaacgaactagtgg

SEQ ID NO: 565795 - DNA, 525 bp, Homo sapiens
  misc_feature: HIJSMM301E0MD2.49.37.D04.1.454.light.4.raw
  modified_base (502)..(502): a, c, t, g, unknown or other
agtcgagagacacgaccggtgctcgatttagtagcatactgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaaacaataaaacaacttaggtgttcggcggcgggaccgaaaactagaccgtcctacgtcagccaaacgcncgcccctccgtccgactctcgtt

SEQ ID NO: 565796 - DNA, 494 bp, Homo sapiens; identical to SEQ ID NO: 542264
  misc_feature: HIJSMM301CT46F.13.6.A06.1.454.light.4.raw

SEQ ID NO: 565797 - DNA, 503 bp, Homo sapiens
  misc_feature: HIJSMM301BMBYH.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcaggtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 565798 - DNA, 441 bp, Homo sapiens
  misc_feature: HIJSMM301CZ6A3.11.3.A03.1.454.light.4.raw
cgagagataccacgaccggtgctcgatttagagagcgtcacagggtcctggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccacccctcctcgtatctctcg

SEQ ID NO: 565799 - DNA, 480 bp, Homo sapiens; identical to SEQ ID NO: 535291
  misc_feature: HIJSMM301AWH2M.22.59.F04.1.454.light.4.raw

SEQ ID NO: 565800 - DNA, 469 bp, Homo sapiens; identical to SEQ ID NO: 536091
  misc_feature: HIJSMM301D8ULF.3.82.H05.1.454.light.4.raw

SEQ ID NO: 565801 - DNA, 499 bp, Homo sapiens; identical to SEQ ID NO: 557878
  misc_feature: HIJSMM301A6KV4.13.81.H04.1.454.light.4.raw

SEQ ID NO: 565802 - DNA, 473 bp, Homo sapiens
  misc_feature: HIJSMM301ATWG7.49.73.G07.1.454.light.4.raw
agtcgagagacacgaccggtgctcgatttagctctacgctcagggcacgaccggtgctcgatttagtagcatactgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttc

SEQ ID NO: 565803 - DNA, 506 bp, Homo sapiens
  misc_feature: HIJSMM301BN3L5.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctcctgaccatcagtgggctccggtccgaggatgaggctgacttatta

SEQ ID NO: 565804 - DNA, 454 bp, Homo sapiens; identical to SEQ ID NO: 535005
  misc_feature: HIJSMM301DS66Z.19.86.H09.1.454.light.4.raw

SEQ ID NO: 565805 - DNA, 504 bp, Homo sapiens
  misc_feature: HIJSMM301C4NFY.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttccccgttattgtcttcggaggtgggaccgatggtcaccgtcctacggtcagcccaacgaccaacccaacctcgt

SEQ ID NO: 565806 - DNA, 488 bp, Homo sapiens
  misc_feature: HIJSMM301AK4CC.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaa

SEQ ID NO: 565807 - DNA, 447 bp, Homo sapiens; identical to SEQ ID NO: 535201
  misc_feature: HIJSMM301CEHZ6.18.9.A09.1.454.light.4.raw

SEQ ID NO: 565808 - DNA, 508 bp, Homo sapiens
  misc_feature: HIJSMM301COL28.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctcctgacaatctctggactccaggccgaggacgaggctgatttttactgttgttcatatgcaggaaggagtgattatgtctttggaagtgggaccaaggtcaccgtccttggtcagcccaaggccaacccactgtcactctgttcccg

SEQ ID NO: 565809 - DNA, 497 bp, Homo sapiens; identical to SEQ ID NO: 558011
  misc_feature: HIJSMM301EVR1Z.51.83.H06.1.454.light.4.raw

SEQ ID NO: 565810 - DNA, 489 bp, Homo sapiens; identical to SEQ ID NO: 544582
  misc_feature: HIJSMM301DC6IA.22.65.F10.1.454.light.4.raw

SEQ ID NO: 565811 - DNA, 493 bp, Homo sapiens; identical to SEQ ID NO: 545970
  misc_feature: HIJSMM301BGOOE.41.72.G06.1.454.light.4.raw

SEQ ID NO: 565812 - DNA, 494 bp, Homo sapiens; identical to SEQ ID NO: 534992
  misc_feature: HIJSMM301ESW4A.9.1.A01.1.454.light.4.raw

SEQ ID NO: 565813 - DNA, 491 bp, Homo sapiens; identical to SEQ ID NO: 536211
  misc_feature: HIJSMM301C5072.16.53.E09.1.454.light.4.raw

SEQ ID NO: 565814 - DNA, 504 bp, Homo sapiens
  misc_feature: HIJSMM301CGZD6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactaggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtcaaacgaactagtgctgcaccatctgtcttcatcttccccg

SEQ ID NO: 565815 - DNA, 508 bp, Homo sapiens
  misc_feature: HIJSMM301DUWJM.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggccccggtggtggtcgtccgttatgatagcgaccggccctcagggatccctgagcgattctctggctccaactctgggaacacggccaccctgaccatcagcagggtcgaagccggggatgaggtcgactattactgtcaggtgtgggatagtagtggtgatcatccatacgtcttcggaactgggaccaaggtctccgtcctacgtcagcccaaggccaactccactgtcactctcg

SEQ ID NO: 565816 - DNA, 509 bp, Homo sapiens
  misc_feature: HIJSMM301DJ2NZ.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggctagtttattactgtcagcaaattattttcttatcctccgtggacgttcggccaagggaccagggtaggaaagtcaggacgaactgtggctgcaccat

SEQ ID NO: 565817 - DNA, 507 bp, Homo sapiens; identical to SEQ ID NO: 561702
  misc_feature: HIJSMM301ADXOU.5.24.C02.1.454.light.4.raw

SEQ ID NO: 565818 - DNA, 509 bp, Homo sapiens; identical to SEQ ID NO: 555801
  misc_feature: HIJSMM301CG2CO.8.33.C11.1.454.light.4.raw

SEQ ID NO: 565819 - DNA, 499 bp, Homo sapiens
  misc_feature: HIJSMM301B8QF7.51.80.H03.1.454.light.4.raw
cgatcgtatacacgaccggtgctcgatttagctgtgcgtcgaagggaaagggctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcactctcgttcccta

SEQ ID NO: 565820 - DNA, 503 bp, Homo sapiens
  misc_feature: HIJSMM301CB1L5.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccta

SEQ ID NO: 565821 - DNA, 503 bp, Homo sapiens; identical to SEQ ID NO: 536834
  misc_feature: HIJSMM301DZWBR.2.35.D02.1.454.light.4.raw

SEQ ID NO: 565822 - DNA, 508 bp, Homo sapiens
  misc_feature: HIJSMM301D2HWO.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggccaacccactgtcact

SEQ ID NO: 565823 - DNA, 472 bp, Homo sapiens; identical to SEQ ID NO: 556898
  misc_feature: HIJSMM301AFB5D.13.76.G10.1.454.light.4.raw

SEQ ID NO: 565824 - DNA, 416 bp, Homo sapiens; identical to SEQ ID NO: 545902
  misc_feature: HIJSMM301DYPN8.18.78.H01.1.454.light.4.raw

SEQ ID NO: 565825 - DNA, 501 bp, Homo sapiens
  misc_feature: HIJSMM301D7ZXE.51.34.D01.1.454.light.4.raw
cgatcgtatacacgaccggtgctcgatttagatcgtctgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaaattgggtgttcggcggagggaccaaaactgaccgtcctaggtcagcccaaggctgccccctcggtcactctgttcccaccctcctctcgtagcact

SEQ ID NO: 565826 - DNA, 494 bp, Homo sapiens; identical to SEQ ID NO: 540664
  misc_feature: HIJSMM301AWU1S.47.64.F09.1.454.light.4.raw

SEQ ID NO: 565827 - DNA, 447 bp, Homo sapiens; identical to SEQ ID NO: 535201
  misc_feature: HIJSMM301C5K3O.18.9.A09.1.454.light.4.raw

SEQ ID NO: 565828 - DNA, 514 bp, Homo sapiens
  misc_feature: HIJSMM301EBRGP.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccgcctcctcgacacgcg

SEQ ID NO: 565829 - DNA, 511 bp, Homo sapiens
  misc_feature: HIJSMM301EWNHB.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactcttcg

SEQ ID NO: 565830 - DNA, 503 bp, Homo sapiens
  misc_feature: HIJSMM301DPFN0.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtcaccgtcctaggtcagcccaaggccaacccca

SEQ ID NO: 565831 - DNA, 509 bp, Homo sapiens
  misc_feature: HIJSMM301A3JX4.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcggaccaagctgaccgtctaggtcagcccaaggctgccccctcggtcact

SEQ ID NO: 565832 - DNA, 520 bp, Homo sapiens
  misc_feature: HIJSMM301CB53C.13.77.G11.1.454.light.4.raw
tcacgtactacacgaccggtgctcgatttagctagtcactcaagggaaaggggtgtctgggcctaaggaagcagcactggtggtgcctcagccatggcctggaccgttctcctcctcggcctcctatctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtcactctgttcccacctcctc

SEQ ID NO: 565833 - DNA, 492 bp, Homo sapiens
  misc_feature: HIJSMM301A46O7.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaaactgtggctgcaccatctgtcttcatt

SEQ ID NO: 565834 - DNA, 481 bp, Homo sapiens
  misc_feature: HIJSMM301EAMEL.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccagggggaccaagctggagatcaaacgaa

SEQ ID NO: 565835 - DNA, 494 bp, Homo sapiens; identical to SEQ ID NO: 554590
  misc_feature: HIJSMM301D1113.10.79.H02.1.454.light.4.raw

SEQ ID NO: 565836 - DNA, 485 bp, Homo sapiens; identical to SEQ ID NO: 535653
  misc_feature: HIJSMM301B9WRF.47.62.F07.1.454.light.4.raw

SEQ ID NO: 565837 - DNA, 501 bp, Homo sapiens
  misc_feature: HIJSMM301DDN6B.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagtagtatgatacctggcctccgtacacttttggccgggggaccaagctaggaaatcaagcgaactgtggctgcacatctgtcttcatcttccccg

SEQ ID NO: 565838 - DNA, 488 bp, Homo sapiens
  misc_feature: HIJSMM301AEL4N.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctggaggatgaggctgattattactgcagctcatatgcaggcagcagcacgtccccatgtgatcgttcgggcgggggaccaagctgaccgtcc

SEQ ID NO: 565839 - DNA, 514 bp, Homo sapiens; identical to SEQ ID NO: 559713
  misc_feature: HIJSMM301D3E52.8.23.C01.1.454.light.4.raw

SEQ ID NO: 565840 - DNA, 507 bp, Homo sapiens; identical to SEQ ID NO: 535641
  misc_feature: HIJSMM301DZ2MY.10.88.H11.1.454.light.4.raw

SEQ ID NO: 565841 - DNA, 481 bp, Homo sapiens; identical to SEQ ID NO: 535993
  misc_feature: HIJSMM301B8QEV.21.25.C03.1.454.light.4.raw

SEQ ID NO: 565842 - DNA, 515 bp, Homo sapiens
  misc_feature: HIJSMM301BX13S.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctcgccccctcggtcactctcgttcccgccctcctcta

SEQ ID NO: 565843 - DNA, 497 bp, Homo sapiens; identical to SEQ ID NO: 539058
  misc_feature: HIJSMM301CIZ5Z.12.87.H10.1.454.light.4.raw

SEQ ID NO: 565844 - DNA, 495 bp, Homo sapiens
  misc_feature: HIJSMM301CCNOY.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactcttccg

SEQ ID NO: 565845 - DNA, 494 bp, Homo sapiens; identical to SEQ ID NO: 534992
  misc_feature: HIJSMM301D14LE.9.1.A01.1.454.light.4.raw

SEQ ID NO: 565846 - DNA, 447 bp, Homo sapiens; identical to SEQ ID NO: 535201
  misc_feature: HIJSMM301CTMIA.18.9.A09.1.454.light.4.raw

SEQ ID NO: 565847 - DNA, 550 bp, Homo sapiens
  misc_feature: HIJSMM301CJ0S7.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcgttcggtcgggggacggtccagttgtaccgtacccgtacggttcgagcccaacggacgtcgtcccccgtcccggtccgacctcttcgttcccggtcccctccccttccactta

SEQ ID NO: 565848 - DNA, 498 bp, Homo sapiens
  misc_feature: HIJSMM301DOASQ.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcctcc

SEQ ID NO: 565849 - DNA, 494 bp, Homo sapiens; identical to SEQ ID NO: 534994
  misc_feature: HIJSMM301AJEEB.27.78.H01.1.454.light.4.raw

SEQ ID NO: 565850 - DNA, 512 bp, Homo sapiens
  misc_feature: HIJSMM301EROXW.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtctaagtcagccaaggctgccccctcggtcactctgttcccgccct

SEQ ID NO: 565851 - DNA, 496 bp, Homo sapiens
  misc_feature: HIJSMM301D5IBO.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctggggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 565852 - DNA, 454 bp, Homo sapiens; identical to SEQ ID NO: 534964
  misc_feature: HIJSMM301AHXDW.19.86.H09.1.454.light.4.raw

SEQ ID NO: 565853 - DNA, 504 bp, Homo sapiens
  misc_feature: HIJSMM301B8H9X.19.78.H01.1.454.light.4.raw
tactctcgtgcacgaccggtgctcgatttagtgtgagtagtttgggtttggggggggtcacaagaggcagcgctctcgggacatctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgt

SEQ ID NO: 565854 - DNA, 483 bp, Homo sapiens
  misc_feature: HIJSMM301DTZWM.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggccgctcattttcggcggagggaccaaggtgcagatcaaacgaactgtggctgca

SEQ ID NO: 565855 - DNA, 495 bp, Homo sapiens; identical to SEQ ID NO: 545183
  misc_feature: HIJSMM301A5V37.16.10.A10.1.454.light.4.raw

SEQ ID NO: 565856 - DNA, 492 bp, Homo sapiens; identical to SEQ ID NO: 537666
  misc_feature: HIJSMM301A2QOE.43.33.C11.1.454.light.4.raw

SEQ ID NO: 565857 - DNA, 494 bp, Homo sapiens
  misc_feature: HIJSMM301CWLFO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtgaaatcaacgaactgtggctgcac

SEQ ID NO: 565858 - DNA, 476 bp, Homo sapiens
  misc_feature: HIJSMM301AXVAT.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtacaaaagtataacagtgcccccttcaccttcggccaagggacacgactggagattagaacg

SEQ ID NO: 565859 - DNA, 502 bp, Homo sapiens; identical to SEQ ID NO: 541971
  misc_feature: HIJSMM301BODYG.4.39.D06.1.454.light.4.raw

SEQ ID NO: 565860 - DNA, 494 bp, Homo sapiens; identical to SEQ ID NO: 534994
  misc_feature: HIJSMM301C6D0G.27.78.H01.1.454.light.4.raw

SEQ ID NO: 565861 - DNA, 507 bp, Homo sapiens
  misc_feature: HIJSMM301BU8AK.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgttctttggaagtgggaccaaggtcaccgtcttggtcagcccaaggccaacccatgtcactctgttccc

SEQ ID NO: 565862 - DNA, 514 bp, Homo sapiens
  misc_feature: HIJSMM301D4PHQ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcaatcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggtggagggaccaagctgaccgtcttaagtcagcccaaggctgccccctcggtcactctgttcccaccctcct

SEQ ID NO: 565863 - DNA, 495 bp, Homo sapiens; identical to SEQ ID NO: 538434
  misc_feature: HIJSMM301DBPEG.51.81.H04.1.454.light.4.raw

SEQ ID NO: 565864 - DNA, 477 bp, Homo sapiens
  misc_feature: HIJSMM301B6R9X.13.34.D01.1.454.light.4.raw
tcacgtactacacgaccggtgctcgatttagatcgtctgtgttgggtttgggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcaggtgggtctgggacagacttcactctcaccatcagcagcctgcagtctgaagatttgcagtctattactgtcagcagtatagttactggagaaccttcggccaagggacacgactggagattaaggaa

SEQ ID NO: 565865 - DNA, 495 bp, Homo sapiens; identical to SEQ ID NO: 549785
  misc_feature: HIJSMM301DQNI2.12.38.D05.1.454.light.4.raw

SEQ ID NO: 565866 - DNA, 513 bp, Homo sapiens
  misc_feature: HIJSMM301BOF4H.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctcctcgctacgtaga

SEQ ID NO: 565867 - DNA, 472 bp, Homo sapiens; identical to SEQ ID NO: 562597
  misc_feature: HIJSMM301BYP5Z.3.38.D05.1.454.light.4.raw

SEQ ID NO: 565868 - DNA, 457 bp, Homo sapiens; identical to SEQ ID NO: 536586
  misc_feature: HIJSMM301BDGAY.49.85.H08.1.454.light.4.raw

SEQ ID NO: 565869 - DNA, 487 bp, Homo sapiens; identical to SEQ ID NO: 536206
  misc_feature: HIJSMM301AUXUQ.47.38.D05.1.454.light.4.raw

SEQ ID NO: 565870 - DNA, 520 bp, Homo sapiens
  misc_feature: HIJSMM301BT7P0.27.23.C01.1.454.light.4.raw
  modified_base (511)..(511): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctnttcccgcct

SEQ ID NO: 565871 - DNA, 480 bp, Homo sapiens; identical to SEQ ID NO: 540683
  misc_feature: HIJSMM301EOWY5.41.5.A05.1.454.light.4.raw

SEQ ID NO: 565872 - DNA, 495 bp, Homo sapiens; identical to SEQ ID NO: 564321
  misc_feature: HIJSMM301BUEL6.15.26.C04.1.454.light.4.raw

SEQ ID NO: 565873 - DNA, 444 bp, Homo sapiens; identical to SEQ ID NO: 535027
  misc_feature: HIJSMM301D6YEX.8.73.G07.1.454.light.4.raw

SEQ ID NO: 565874 - DNA, 502 bp, Homo sapiens; identical to SEQ ID NO: 538730
  misc_feature: HIJSMM301BM5O3.15.1.A01.1.454.light.4.raw

SEQ ID NO: 565875 - DNA, 506 bp, Homo sapiens
  misc_feature: HIJSMM301A5DSM.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaacgggaccgaacggtagggaaagtactaaacgaaactagtggcgtgcgaccactctgtt

SEQ ID NO: 565876 - DNA, 501 bp, Homo sapiens
  misc_feature: HIJSMM301BYD0E.43.77.G11.1.454.light.4.raw
tgtgagtagtcacgaccggtgctcgatttagctagtcactcaagggaaagggggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtcctaggtcagcccaaggccaaccca

SEQ ID NO: 565877 - DNA, 494 bp, Homo sapiens; identical to SEQ ID NO: 535611
  misc_feature: HIJSMM301B19TY.3.14.B03.1.454.light.4.raw

SEQ ID NO: 565878 - DNA, 444 bp, Homo sapiens; identical to SEQ ID NO: 535594
  misc_feature: HIJSMM301D884V.9.9.A09.1.454.light.4.raw

SEQ ID NO: 565879 - DNA, 521 bp, Homo sapiens; identical to SEQ ID NO: 539470
  misc_feature: HIJSMM301CSAI0.27.23.C01.1.454.light.4.raw

SEQ ID NO: 565880 - DNA, 486 bp, Homo sapiens
  misc_feature: HIJSMM301DK1YA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggacacgtcccaagaacttttggccaggggaccaagctggagatcaaacgaactgtggctgcaccat

SEQ ID NO: 565881 - DNA, 519 bp, Homo sapiens; identical to SEQ ID NO: 565099
  misc_feature: HIJSMM301DJN8S.53.65.F10.1.454.light.4.raw

SEQ ID NO: 565882 - DNA, 503 bp, Homo sapiens; identical to SEQ ID NO: 545496
  misc_feature: HIJSMM301DROA5.8.24.C02.1.454.light.4.raw

SEQ ID NO: 565883 - DNA, 490 bp, Homo sapiens
  misc_feature: HIJSMM301D2IXP.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctggaccagagtggatatcaaacgaactagtggctgcaccatctgtctt

SEQ ID NO: 565884 - DNA, 444 bp, Homo sapiens; identical to SEQ ID NO: 536685
  misc_feature: HIJSMM301B7TQ6.10.76.G10.1.454.light.4.raw

SEQ ID NO: 565885 - DNA, 521 bp, Homo sapiens; identical to SEQ ID NO: 538715
  misc_feature: HIJSMM301APW32.27.23.C01.1.454.light.4.raw

SEQ ID NO: 565886 - DNA, 491 bp, Homo sapiens; identical to SEQ ID NO: 559129
  misc_feature: HIJSMM301CO5KY.10.20.B09.1.454.light.4.raw

SEQ ID NO: 565887 - DNA, 516 bp, Homo sapiens
  misc_feature: HIJSMM301BZWWB.13.38.D05.1.454.light.4.raw
tcacgtactacacgaccggtgctcgatttagtatctgatagttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtgtccacggacgaacggtggaagtacaagacgaactacgtggcgtgtcgaccaactactcgtctttcctactcttcccgt

SEQ ID NO: 565888 - DNA, 491 bp, Homo sapiens; identical to SEQ ID NO: 541413
  misc_feature: HIJSMM301DR505.14.28.C06.1.454.light.4.raw

SEQ ID NO: 565889 - DNA, 508 bp, Homo sapiens
  misc_feature: HIJSMM301CVQ5I.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgtagtatattactgtcagcaatatggtacttcacccccggagttcggccaagggaccaaggtggaagtacaacgaactagtggctgcaccatctgtcttcatcttccgccatctga

SEQ ID NO: 565890 - DNA, 510 bp, Homo sapiens
  misc_feature: HIJSMM301A9CY9.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcact

SEQ ID NO: 565891 - DNA, 491 bp, Homo sapiens
  misc_feature: HIJSMM301EALFP.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcacatctgtcttcatt

SEQ ID NO: 565892 - DNA, 489 bp, Homo sapiens
  misc_feature: HIJSMM301EQ56B.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcgt

SEQ ID NO: 565893 - DNA, 491 bp, Homo sapiens
  misc_feature: HIJSMM301C3F69.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgcagtttttactgtcagcagtatagtaactggcctccgtacacttttggccaggggaccaagctagaaatcaaacgactgtggctgcaccatctgtcttc

SEQ ID NO: 565894 - DNA, 491 bp, Homo sapiens; identical to SEQ ID NO: 535294
  misc_feature: HIJSMM301BKM77.16.68.G02.1.454.light.4.raw

SEQ ID NO: 565895 - DNA, 494 bp, Homo sapiens; identical to SEQ ID NO: 536974
  misc_feature: HIJSMM301BIATH.16.86.H09.1.454.light.4.raw

SEQ ID NO: 565896 - DNA, 505 bp, Homo sapiens; identical to SEQ ID NO: 536254
  misc_feature: HIJSMM301BENOQ.7.71.G05.1.454.light.4.raw

SEQ ID NO: 565897 - DNA, 488 bp, Homo sapiens; identical to SEQ ID NO: 537260
  misc_feature: HIJSMM301BJ8T6.47.70.G04.1.454.light.4.raw

SEQ ID NO: 565898 - DNA, 495 bp, Homo sapiens; identical to SEQ ID NO: 536931
  misc_feature: HIJSMM301EQ5J0.10.33.C11.1.454.light.4.raw

SEQ ID NO: 565899 - DNA, 487 bp, Homo sapiens
  misc_feature: HIJSMM301EXDUG.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctcaccctgtctgcagcagtcggagacagagtcaccatcacctgccgggccagtcagaatcttggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 565900 - DNA, 494 bp, Homo sapiens; identical to SEQ ID NO: 534992
  misc_feature: HIJSMM301DLEFB.9.1.A01.1.454.light.4.raw

SEQ ID NO: 565901 - DNA, 480 bp, Homo sapiens; identical to SEQ ID NO: 535630
  misc_feature: HIJSMM301BYJ9O.40.59.F04.1.454.light.4.raw

SEQ ID NO: 565902 - DNA, 491 bp, Homo sapiens
  misc_feature: HIJSMM301C2WZ7.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaagggacacgactggagattaaacgaactgtggctgcaccatctgtcttcatt

SEQ ID NO: 565903 - DNA, 490 bp, Homo sapiens
  misc_feature: HIJSMM301DWQH2.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtgggatcagacacagattttacactgaaaatcagtagagtggaggctgaggatgttggagtttattactgcatgcaagctctacaaactcctctcactttcggcggtagggaccaaggtggagagtcaaacgaactgt

SEQ ID NO: 565904 - DNA, 504 bp, Homo sapiens
  misc_feature: HIJSMM301ETR8I.12.53.E09.1.454.light.4.raw
atacgacgtacacgaccggtgctcgatttagagagagtgtgttgggtttgggggctttgcctgggctcttctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctcctctacgtcgtat

SEQ ID NO: 565905 - DNA, 484 bp, Homo sapiens; identical to SEQ ID NO: 545944
  misc_feature: HIJSMM301BVLBV.46.35.D02.1.454.light.4.raw

SEQ ID NO: 565906 - DNA, 466 bp, Homo sapiens; identical to SEQ ID NO: 541765
  misc_feature: HIJSMM301CXTQX.11.70.G04.1.454.light.4.raw

SEQ ID NO: 565907 - DNA, 511 bp, Homo sapiens
  misc_feature: HIJSMM301EO89N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaaggtggaaagtacaaacgaaacctagtggctgcaccactctgtcttcatcttccccg

SEQ ID NO: 565908 - DNA, 496 bp, Homo sapiens
  misc_feature: HIJSMM301D770P.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggaccccaggtggagatcagacgaactgtggctgcaccatctgtcttcatcttcccg

SEQ ID NO: 565909 - DNA, 494 bp, Homo sapiens
  misc_feature: HIJSMM301AM5DI.43.49.E05.1.454.light.4.raw
tgtgagtagtcacgaccggtgctcgatttagagcgactagcaacacacaaaggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacc

SEQ ID NO: 565910 - DNA, 496 bp, Homo sapiens
  misc_feature: HIJSMM301CWA09.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacgggaccgaaggtacggaaatacaaacgaaacctagtggctgcaccaa

SEQ ID NO: 565911 - DNA, 494 bp, Homo sapiens
  misc_feature: HIJSMM301BBEF1.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagtagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaaggaccacgggtggaatacaagcgaactagtggctgcaccactctgtcttcta

SEQ ID NO: 565912 - DNA, 503 bp, Homo sapiens; identical to SEQ ID NO: 538884
  misc_feature: HIJSMM301EU4V1.27.78.H01.1.454.light.4.raw

SEQ ID NO: 565913 - DNA, 463 bp, Homo sapiens
  misc_feature: HIJSMM301AIZTX.49.4.A04.1.454.light.4.raw
agtcgagagacacgaccggtgctcgatttagagtagtgatcagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaa

SEQ ID NO: 565914 - DNA, 503 bp, Homo sapiens
  misc_feature: HIJSMM301CG9Q9.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagccaaggctgccccctcggtcta

SEQ ID NO: 565915 - DNA, 506 bp, Homo sapiens; identical to SEQ ID NO: 535058
  misc_feature: HIJSMM301BPGX2.17.41.D08.1.454.light.4.raw

SEQ ID NO: 565916 - DNA, 521 bp, Homo sapiens; identical to SEQ ID NO: 539470
  misc_feature: HIJSMM301A6O7Z.27.23.C01.1.454.light.4.raw

SEQ ID NO: 565917 - DNA, 503 bp, Homo sapiens; identical to SEQ ID NO: 551912
  misc_feature: HIJSMM301ARRV3.12.50.E06.1.454.light.4.raw

SEQ ID NO: 565918 - DNA, 501 bp, Homo sapiens
  misc_feature: HIJSMM301BOQP3.52.27.C05.1.454.light.4.raw
cgcagtacgacacgaccggtgctcgatttagacgcgatcgaagggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcaggggacaacgggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 565919 - DNA, 483 bp, Homo sapiens
  misc_feature: HIJSMM301AUKYM.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcatttattactgtcagcagtatcataactggccgctcaccttcggccaagggacacgactggagattaaacgaactgtggctgcaccat

SEQ ID NO: 565920 - DNA, 504 bp, Homo sapiens; identical to SEQ ID NO: 538940
  misc_feature: HIJSMM301D0HJN.2.35.D02.1.454.light.4.raw

SEQ ID NO: 565921 - DNA, 498 bp, Homo sapiens
  misc_feature: HIJSMM301B6CDS.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcagcagcactcaagtcttcggaactgggaccaaggtcacgtcctaggtcagcccaaggccaa

SEQ ID NO: 565922 - DNA, 509 bp, Homo sapiens; identical to SEQ ID NO: 548681
  misc_feature: HIJSMM301A4XSM.47.83.H06.1.454.light.4.raw

SEQ ID NO: 565923 - DNA, 506 bp, Homo sapiens; identical to SEQ ID NO: 539721
  misc_feature: HIJSMM301DI78X.3.79.H02.1.454.light.4.raw

SEQ ID NO: 565924 - DNA, 509 bp, Homo sapiens
  misc_feature: HIJSMM301CUG99.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgattttactgctgctcatatgcaggtgatcacacttttatgttcgggactgggaccaaggtcaccgtcctaggtcagcccaaggccaacccactgtcactctcg

SEQ ID NO: 565925 - DNA, 510 bp, Homo sapiens
  misc_feature: HIJSMM301CXDAU.4.57.F02.1.454.light.4.raw
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccaactcgtcactctcgttcca

SEQ ID NO: 565926 - DNA, 489 bp, Homo sapiens; identical to SEQ ID NO: 536013
  misc_feature: HIJSMM301EN2YI.26.23.C01.1.454.light.4.raw

SEQ ID NO: 565927 - DNA, 492 bp, Homo sapiens
  misc_feature: HIJSMM301A0XKM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaggtggaggtcaaacgaactgtggctgcaccatctgtcttcatt

SEQ ID NO: 565928 - DNA, 507 bp, Homo sapiens
  misc_feature: HIJSMM301DQK0F.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttccgccc

SEQ ID NO: 565929 - DNA, 502 bp, Homo sapiens
  misc_feature: HIJSMM301C6O12.9.53.E09.1.454.light.4.raw
tgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 565930 - DNA, 502 bp, Homo sapiens
  misc_feature: HIJSMM301EAOCM.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaatcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 565931 - DNA, 486 bp, Homo sapiens
  misc_feature: HIJSMM301D58BF.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggtcggagggaccaagctgaccgtcctacggtcagccccg

SEQ ID NO: 565932 - DNA, 486 bp, Homo sapiens; identical to SEQ ID NO: 535043
  misc_feature: HIJSMM301C3K20.46.35.D02.1.454.light.4.raw

SEQ ID NO: 565933 - DNA, 480 bp, Homo sapiens
  misc_feature: HIJSMM301C3XZ8.9.76.G10.1.454.light.4.raw
tgatacgtctcacgaccggtgctcgatttagtcactcatacagggggggtagagaagacaggactcaggacaatctccagcatggcctggtcccctcctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtcctaggtcagcccaa

SEQ ID NO: 565934 - DNA, 505 bp, Homo sapiens; identical to SEQ ID NO: 563271
  misc_feature: HIJSMM301CTY97.2.21.B10.1.454.light.4.raw

SEQ ID NO: 565935 - DNA, 489 bp, Homo sapiens; identical to SEQ ID NO: 542689
  misc_feature: HIJSMM301EV46L.4.64.F09.1.454.light.4.raw

SEQ ID NO: 565936 - DNA, 416 bp, Homo sapiens; identical to SEQ ID NO: 539343
  misc_feature: HIJSMM301CRKZW.18.78.H01.1.454.light.4.raw

SEQ ID NO: 565937 - DNA, 485 bp, Homo sapiens; identical to SEQ ID NO: 561867
  misc_feature: HIJSMM301D5146.46.26.C04.1.454.light.4.raw

SEQ ID NO: 565938 - DNA, 490 bp, Homo sapiens; identical to SEQ ID NO: 538273
  misc_feature: HIJSMM301B5EHT.16.73.G07.1.454.light.4.raw

SEQ ID NO: 565939 - DNA, 455 bp, Homo sapiens
  misc_feature: HIJSMM301DZY9D.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaaagctgaccgtcctaagtcagcccaaggctgccccctcggtcactctgttcccaccctcctccacgagagta

SEQ ID NO: 565940 - DNA, 445 bp, Homo sapiens
  misc_feature: HIJSMM301BE1KN.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctcgttcccaccctcctcgtgtctgat

SEQ ID NO: 565941 - DNA, 490 bp, Homo sapiens
  misc_feature: HIJSMM301BPZAF.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcagacgaactgtggctgcaccat

SEQ ID NO: 565942 - DNA, 505 bp, Homo sapiens
  misc_feature: HIJSMM301AJ5T5.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcca

SEQ ID NO: 565943 - DNA, 494 bp, Homo sapiens; identical to SEQ ID NO: 535276
  misc_feature: HIJSMM301ERYHE.16.6.A06.1.454.light.4.raw

SEQ ID NO: 565944 - DNA, 510 bp, Homo sapiens; identical to SEQ ID NO: 545115
  misc_feature: HIJSMM301ANA7H.19.59.F04.1.454.light.4.raw

SEQ ID NO: 565945 - DNA, 505 bp, Homo sapiens
  misc_feature: HIJSMM301ATA6P.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggccctcgggaccaaagtggatatcaaacgaactgtggctgcaccatctgt

SEQ ID NO: 565946 - DNA, 502 bp, Homo sapiens; identical to SEQ ID NO: 539314
  misc_feature: HIJSMM301AROOB.21.81.H04.1.454.light.4.raw

SEQ ID NO: 565947 - DNA, 486 bp, Homo sapiens
  misc_feature: HIJSMM301AMDDB.48.40.D07.1.454.light.4.raw
agtatacatacacgaccggtgctcgatttagtgatagagcgtaacaacagagggggatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaagggaccaacggtggaggatcaaacg

SEQ ID NO: 565948 - DNA, 508 bp, Homo sapiens
  misc_feature: HIJSMM301DMMHF.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtccgtgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatatcttcggaactgggaccaaggtcaccgtcctaggtcagcccaaggccaaccccactgtcta

SEQ ID NO: 565949 - DNA, 492 bp, Homo sapiens; identical to SEQ ID NO: 534967
  misc_feature: HIJSMM301AMUNQ.47.64.F09.1.454.light.4.raw

SEQ ID NO: 565950 - DNA, 503 bp, Homo sapiens; identical to SEQ ID NO: 536834
  misc_feature: HIJSMM301BGRKG.2.35.D02.1.454.light.4.raw

SEQ ID NO: 565951 - DNA, 383 bp, Homo sapiens
  misc_feature: HIJSMM301B13EG.48.53.E09.1.454.light.4.raw
agtatacatacacgaccggtgctcgatttagagagagtgtgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 565952 - DNA, 463 bp, Homo sapiens; identical to SEQ ID NO: 535008
  misc_feature: HIJSMM301BZGZL.10.9.A09.1.454.light.4.raw

SEQ ID NO: 565953 - DNA, 486 bp, Homo sapiens; identical to SEQ ID NO: 535043
  misc_feature: HIJSMM301BKROU.46.35.D02.1.454.light.4.raw

SEQ ID NO: 565954 - DNA, 513 bp, Homo sapiens
  misc_feature: HIJSMM301DQ9P4.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctc

SEQ ID NO: 565955 - DNA, 508 bp, Homo sapiens
  misc_feature: HIJSMM301E3H37.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttgggtgttcggcggagggaccaagttgaccgtcctaggtcagcccaaggctgccccctcggtcactctgtt

SEQ ID NO: 565956 - DNA, 495 bp, Homo sapiens
  misc_feature: HIJSMM301BDUZO.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgcatctgactac

SEQ ID NO: 565957 - DNA, 444 bp, Homo sapiens; identical to SEQ ID NO: 535192
  misc_feature: HIJSMM301DQ701.5.9.A09.1.454.light.4.raw

SEQ ID NO: 565958 - DNA, 506 bp, Homo sapiens
  misc_feature: HIJSMM301CGOZY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccgaaggtaggaaatacaaacgaactagtgcgtgcaccatcctgtcttcatcttccccg

SEQ ID NO: 565959 - DNA, 444 bp, Homo sapiens; identical to SEQ ID NO: 535027
  misc_feature: HIJSMM301AG4VV.8.73.G07.1.454.light.4.raw

SEQ ID NO: 565960 - DNA, 496 bp, Homo sapiens
  misc_feature: HIJSMM301AJY1J.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggtccctcggaccgaaacgtaggataatctaaaacgaactagtggctgcaccaactctgtt

SEQ ID NO: 565961 - DNA, 503 bp, Homo sapiens; identical to SEQ ID NO: 535044
  misc_feature: HIJSMM301BZ54P.19.78.H01.1.454.light.4.raw

SEQ ID NO: 565962 - DNA, 486 bp, Homo sapiens; identical to SEQ ID NO: 537428
  misc_feature: HIJSMM301A4CSA.47.62.F07.1.454.light.4.raw

SEQ ID NO: 565963 - DNA, 504 bp, Homo sapiens
  misc_feature: HIJSMM301BRJNW.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgt

SEQ ID NO: 565964 - DNA, 476 bp, Homo sapiens
  misc_feature: HIJSMM301AYP91.43.12.B01.1.454.light.4.raw
tgtgagtagtcacgaccggtgctcgatttagtagtgtagattccgcgggggcaggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtgg

SEQ ID NO: 565965 - DNA, 498 bp, Homo sapiens; identical to SEQ ID NO: 542913
  misc_feature: HIJSMM301CF97I.51.26.C04.1.454.light.4.raw

SEQ ID NO: 565966 - DNA, 506 bp, Homo sapiens
  misc_feature: HIJSMM301CMYKS.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtctac

SEQ ID NO: 565967 - DNA, 499 bp, Homo sapiens
  misc_feature: HIJSMM301C6LR0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccaaccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtctt

SEQ ID NO: 565968 - DNA, 521 bp, Homo sapiens; identical to SEQ ID NO: 539470
  misc_feature: HIJSMM301DAHLW.27.23.C01.1.454.light.4.raw

SEQ ID NO: 565969 - DNA, 504 bp, Homo sapiens
  misc_feature: HIJSMM301DZE58.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggcact

SEQ ID NO: 565970 - DNA, 448 bp, Homo sapiens; identical to SEQ ID NO: 538166
  misc_feature: HIJSMM301BUKD8.18.9.A09.1.454.light.4.raw

SEQ ID NO: 565971 - DNA, 504 bp, Homo sapiens; identical to SEQ ID NO: 535128
  misc_feature: HIJSMM301CG4WC.19.85.H08.1.454.light.4.raw

SEQ ID NO: 565972 - DNA, 508 bp, Homo sapiens; identical to SEQ ID NO: 536062
  misc_feature: HIJSMM301DE639.11.57.F02.1.454.light.4.raw

SEQ ID NO: 565973 - DNA, 495 bp, Homo sapiens; identical to SEQ ID NO: 543631
  misc_feature: HIJSMM301A0TGB.11.59.F04.1.454.light.4.raw

SEQ ID NO: 565974 - DNA, 496 bp, Homo sapiens
  misc_feature: HIJSMM301DVAGM.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccaagctggagatcaaacgaactgtggctgcaccatctgtctt

SEQ ID NO: 565975 - DNA, 463 bp, Homo sapiens
  misc_feature: HIJSMM301BPK7D.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaaagaactatttaaattggtatcggcagcgaccagggaaagcccctgagctcctgatctacgatgcgtccaattggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 565976 - DNA, 502 bp, Homo sapiens; identical to SEQ ID NO: 543172
  misc_feature: HIJSMM301DM7H9.18.59.F04.1.454.light.4.raw

SEQ ID NO: 565977 - DNA, 485 bp, Homo sapiens
  misc_feature: HIJSMM301DTI0F.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaagttatgagacccctgccactttcggccctgggaccatagtggatatgaaacgaactgtggctgcacc

SEQ ID NO: 565978 - DNA, 466 bp, Homo sapiens
  misc_feature: HIJSMM301EJ82N.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaa

SEQ ID NO: 565979 - DNA, 484 bp, Homo sapiens
  misc_feature: HIJSMM301DVWL0.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcccgcaggctgaagatgtggcagcttattattgtcagcaatattatacttctcttccgatcacttttggccaggggaccaggctggagatcagacgaactgt

SEQ ID NO: 565980 - DNA, 495 bp, Homo sapiens; identical to SEQ ID NO: 535486
  misc_feature: HIJSMM301D29MQ.26.72.G06.1.454.light.4.raw

SEQ ID NO: 565981 - DNA, 479 bp, Homo sapiens; identical to SEQ ID NO: 540873
  misc_feature: HIJSMM301BL3SB.40.59.F04.1.454.light.4.raw

SEQ ID NO: 565982 - DNA, 506 bp, Homo sapiens
  misc_feature: HIJSMM301AXZ8L.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtaggaaagtacaaacgaactagtggctgcaccact

SEQ ID NO: 565983 - DNA, 487 bp, Homo sapiens
  misc_feature: HIJSMM301BME4U.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttatactgtcagcaatattctactactcctcggactttcggcggagggaccgaaggtggagatacaaacgaa

SEQ ID NO: 565984 - DNA, 498 bp, Homo sapiens
  misc_feature: HIJSMM301B3IVS.9.53.E09.1.454.light.4.raw
  modified_base (441)..(441): a, c, t, g, unknown or other
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatgggtnacactcccgtggtattcggcggagggaccaaggtgaccgtcctaggtcagcccaagg

SEQ ID NO: 565985 - DNA, 501 bp, Homo sapiens; identical to SEQ ID NO: 535873
  misc_feature: HIJSMM301DC4DM.17.27.C05.1.454.light.4.raw

SEQ ID NO: 565986 - DNA, 506 bp, Homo sapiens
  misc_feature: HIJSMM301EW5QT.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctggggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactc

SEQ ID NO: 565987 - DNA, 492 bp, Homo sapiens; identical to SEQ ID NO: 552519
  misc_feature: HIJSMM301C6SA8.10.72.G06.1.454.light.4.raw

SEQ ID NO: 565988 - DNA, 522 bp, Homo sapiens
  misc_feature: HIJSMM301CLEEZ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaaacagactgcagcctgaagatattgctagtttactactgtcagcagtatgttacgtccccgtggacgttcggccaagggaccaaggtggcaatcaaccgaactgtggctgcaccatctgtcttcatccttccccg

SEQ ID NO: 565989 - DNA, 493 bp, Homo sapiens; identical to SEQ ID NO: 537281
  misc_feature: HIJSMM301BANL1.9.1.A01.1.454.light.4.raw

SEQ ID NO: 565990 - DNA, 492 bp, Homo sapiens; identical to SEQ ID NO: 549170
  misc_feature: HIJSMM301CIJ2Q.40.81.H04.1.454.light.4.raw

SEQ ID NO: 565991 - DNA, 513 bp, Homo sapiens
  misc_feature: HIJSMM301C386M.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaggaccgaacggtaggaagtacaagacgaactcgtggcgtgtcgaccactctcgtcttctactcttcccgt

SEQ ID NO: 565992 - DNA, 495 bp, Homo sapiens
  misc_feature: HIJSMM301EJTDB.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgactgtggctgcaccatctgtcttcatcttcccgcat

SEQ ID NO: 565993 - DNA, 494 bp, Homo sapiens; identical to SEQ ID NO: 539784
  misc_feature: HIJSMM301DY6TL.22.57.F02.1.454.light.4.raw

SEQ ID NO: 565994 - DNA, 494 bp, Homo sapiens; identical to SEQ ID NO: 534994
  misc_feature: HIJSMM301CU26C.27.78.H01.1.454.light.4.raw

SEQ ID NO: 565995 - DNA, 496 bp, Homo sapiens
  misc_feature: HIJSMM301AKU72.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagttggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccc

SEQ ID NO: 565996 - DNA, 454 bp, Homo sapiens; identical to SEQ ID NO: 535005
  misc_feature: HIJSMM301DW3VW.19.86.H09.1.454.light.4.raw

SEQ ID NO: 565997 - DNA, 508 bp, Homo sapiens; identical to SEQ ID NO: 536388
  misc_feature: HIJSMM301A4IAH.11.57.F02.1.454.light.4.raw

SEQ ID NO: 565998 - DNA, 455 bp, Homo sapiens
  misc_feature: HIJSMM301BHOSG.19.86.H09.1.454.light.4.raw
tactctcgtgcacgaccggtgctcgatttagtgctatagacttgggtttggggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 565999 - DNA, 488 bp, Homo sapiens; identical to SEQ ID NO: 536554
  misc_feature: HIJSMM301A51MS.26.37.D04.1.454.light.4.raw

SEQ ID NO: 566000 - DNA, 496 bp, Homo sapiens
  misc_feature: HIJSMM301DXSYG.41.16.B05.1.454.light.4.raw
tctatactatcacgaccggtgctcgatttagagctcacgtaagggggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccgagggaccaagctcgagatacaaacgaactgtggctgcaccatctgtcttcatcttcccg

SEQ ID NO: 566001 - DNA, 486 bp, Homo sapiens; identical to SEQ ID NO: 565068
  misc_feature: HIJSMM301CP0LV.8.74.G08.1.454.light.4.raw

SEQ ID NO: 566002 - DNA, 486 bp, Homo sapiens; identical to SEQ ID NO: 535917
  misc_feature: HIJSMM301AVARS.3.10.A10.1.454.light.4.raw

SEQ ID NO: 566003 - DNA, 499 bp, Homo sapiens
  misc_feature: HIJSMM301A4BO6.48.82.H05.1.454.light.4.raw
agtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcacctcatatacaagcagcagcactctcgtggtattcggcggagggaccaaggctgaccgtcctaggtcagccaaggctgccccctc

SEQ ID NO: 566004 - DNA, 445 bp, Homo sapiens; identical to SEQ ID NO: 551271
  misc_feature: HIJSMM301C28MP.5.9.A09.1.454.light.4.raw

SEQ ID NO: 566005 - DNA, 493 bp, Homo sapiens
  misc_feature: HIJSMM301A16HW.10.32.C10.1.454.light.4.raw
catagtagtgcacgaccggtgctcgatttagtatagacatcaacacacaaagggggcaggagtcagtctcagtcaggacacagcatggacatgagggtccccgctcagctcctggggctcctgctactctggctccgaggtgccagatgtgacatcccagatgacccagtcgtccaccgtccctgtctgcatttgtaggagacagagtcaccatctcttgccgggcaagtcagaacattgacacttatttaaattggtatcaacaaaaactggggaaagcccctacactcctgatcaatgctgcgtccagtttacagagtggggtcccatcaaggttcagtggcagtggatctgggacagactttactctcaccatcagcgatctgcagcctgacgattttgcgacttactactgtcaacagagtttccggaacccgttactttcggcggagggaccaaggtggagatcaaacgactgtgctgcaccatctgt

SEQ ID NO: 566006 - DNA, 488 bp, Homo sapiens; identical to SEQ ID NO: 535125
  misc_feature: HIJSMM301CJGCV.17.25.C03.1.454.light.4.raw

SEQ ID NO: 566007 - DNA, 495 bp, Homo sapiens; identical to SEQ ID NO: 557929
  misc_feature: HIJSMM301AG2GU.43.9.A09.1.454.light.4.raw

SEQ ID NO: 566008 - DNA, 487 bp, Homo sapiens
  misc_feature: HIJSMM301DNOJQ.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagatctgcaacttattactgtctccagtatgatgcttaccctcggactttcggtccgaaggaccgaaggtaggaaatacaaacgaactagtggctgcacca

SEQ ID NO: 566009 - DNA, 515 bp, Homo sapiens
  misc_feature: HIJSMM301EOPVB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaacggtaggaagtacgaaacgaactacgtggcgtgcaccactctgtcttctactcttcccgtcccact

SEQ ID NO: 566010 - DNA, 444 bp, Homo sapiens; identical to SEQ ID NO: 535192
  misc_feature: HIJSMM301D97CE.5.9.A09.1.454.light.4.raw

SEQ ID NO: 566011 - DNA, 517 bp, Homo sapiens
  misc_feature: HIJSMM301E0DZ6.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgccccctcggtcactctgttcccc

SEQ ID NO: 566012 - DNA, 498 bp, Homo sapiens
  misc_feature: HIJSMM301ATLVG.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagccaaggctgcccctcggtca

SEQ ID NO: 566013 - DNA, 353 bp, Homo sapiens; identical to SEQ ID NO: 536338
  misc_feature: HIJSMM301CTLS0.3.11.A11.1.454.light.4.raw

SEQ ID NO: 566014 - DNA, 499 bp, Homo sapiens
  misc_feature: HIJSMM301DPG4N.48.73.G07.1.454.light.4.raw
agtatacatacacgaccggtgctcgatttagctctacgctctaagggaaagggggaggaactgctcagttaggacccagacggaaccatggaagccccagcgcagcttctcttcctcctgctactctggctcccagatgtcactggagaaaaataatgacgcagtctccagccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccaagggaccaaggtggaaatcaaacgaactgtgg

SEQ ID NO: 566015 - DNA, 486 bp, Homo sapiens; identical to SEQ ID NO: 535917
  misc_feature: HIJSMM301BF89J.3.10.A10.1.454.light.4.raw

SEQ ID NO: 566016 - DNA, 486 bp, Homo sapiens; identical to SEQ ID NO: 535043
  misc_feature: HIJSMM301CWBFX.46.35.D02.1.454.light.4.raw

SEQ ID NO: 566017 - DNA, 495 bp, Homo sapiens
  misc_feature: HIJSMM301C1IAU.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaagggacacgactggagattaaaggaactgtggctgcaccatctgtcttcatcttccccg

SEQ ID NO: 566018 - DNA, 486 bp, Homo sapiens; identical to SEQ ID NO: 535043
  misc_feature: HIJSMM301A7K8M.46.35.D02.1.454.light.4.raw

SEQ ID NO: 566019 - DNA, 520 bp, Homo sapiens; identical to SEQ ID NO: 537173
  misc_feature: HIJSMM301A0BOF.27.23.C01.1.454.light.4.raw

SEQ ID NO: 566020 - DNA, 494 bp, Homo sapiens
  misc_feature: HIJSMM301ASTHB.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattatattgctgctcatatggaagtacctactcttttctcttcggaactgggaccacggtcaccgtcctaggtcagcccaaggccaaccca

SEQ ID NO: 566021 - DNA, 503 bp, Homo sapiens
  misc_feature: HIJSMM301DLO2R.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtctaggtcagcccaaggctcgccccctcggtctacc

SEQ ID NO: 566022 - DNA, 498 bp, Homo sapiens
  misc_feature: HIJSMM301AE12W.40.59.F04.1.454.light.4.raw
tctagcgactcacgaccggtgctcgatttagtacacacacttagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccactcactttcggcggagggaccgaaggtggaggatcaaacgaactgtggctgcaccatctgtcttcat

SEQ ID NO: 566023 - DNA, 512 bp, Homo sapiens
  misc_feature: HIJSMM301BIWDT.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtccact

SEQ ID NO: 566024 - DNA, 515 bp, Homo sapiens
  misc_feature: HIJSMM301DAPAQ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaagggctggcacctcagccctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcacttctcctccctcctcct

SEQ ID NO: 566025 - DNA, 510 bp, Homo sapiens
  misc_feature: HIJSMM301COLMU.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacctttcggccctgggaccaaagtaggatatcaaacgaactgtggctgcaccatctgtcttcta

SEQ ID NO: 566026 - DNA, 511 bp, Homo sapiens; identical to SEQ ID NO: 549024
  misc_feature: HIJSMM301DL5OE.14.7.A07.1.454.light.4.raw

SEQ ID NO: 566027 - DNA, 506 bp, Homo sapiens; identical to SEQ ID NO: 543993
  misc_feature: HIJSMM301B0BC4.18.78.H01.1.454.light.4.raw

SEQ ID NO: 566028 - DNA, 491 bp, Homo sapiens
  misc_feature: HIJSMM301D6TPR.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaaggcggagatcagacgaactcgtggctgcaccatctgtcttcta

SEQ ID NO: 566029 - DNA, 478 bp, Homo sapiens; identical to SEQ ID NO: 535129
  misc_feature: HIJSMM301A6BJY.11.11.A11.1.454.light.4.raw

SEQ ID NO: 566030 - DNA, 521 bp, Homo sapiens
  misc_feature: HIJSMM301DK2Q0.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacgggaccgaacggtaggaaggtacgaaacgaaaccgtagttggcgtgcaccaactctgtcttctactcttcccgtccact

SEQ ID NO: 566031 - DNA, 486 bp, Homo sapiens; identical to SEQ ID NO: 535385
  misc_feature: HIJSMM301EYUVE.19.71.G05.1.454.light.4.raw

SEQ ID NO: 566032 - DNA, 501 bp, Homo sapiens
  misc_feature: HIJSMM301BQHCO.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgcca

SEQ ID NO: 566033 - DNA, 486 bp, Homo sapiens
  misc_feature: HIJSMM301CHIRH.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgactgtggctgcacc

SEQ ID NO: 566034 - DNA, 491 bp, Homo sapiens
  misc_feature: HIJSMM301D68RC.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccagggggaccaaactggatatcagacgaactgtggctgca

SEQ ID NO: 566035 - DNA, 503 bp, Homo sapiens; identical to SEQ ID NO: 538884
  misc_feature: HIJSMM301EWPOC.27.78.H01.1.454.light.4.raw

SEQ ID NO: 566036 - DNA, 495 bp, Homo sapiens
  misc_feature: HIJSMM301DP0S9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcacatctgt

SEQ ID NO: 566037 - DNA, 492 bp, Homo sapiens; identical to SEQ ID NO: 539630
  misc_feature: HIJSMM301BWXCG.22.25.C03.1.454.light.4.raw

SEQ ID NO: 566038 - DNA, 482 bp, Homo sapiens; identical to SEQ ID NO: 535216
  misc_feature: HIJSMM301DOZKV.17.26.C04.1.454.light.4.raw

SEQ ID NO: 566039 - DNA, 456 bp, Homo sapiens; identical to SEQ ID NO: 539131
  misc_feature: HIJSMM301AHZ68.19.86.H09.1.454.light.4.raw

SEQ ID NO: 566040 - DNA, 498 bp, Homo sapiens; identical to SEQ ID NO: 537020
  misc_feature: HIJSMM301DGJB7.26.26.C04.1.454.light.4.raw

SEQ ID NO: 566041 - DNA, 498 bp, Homo sapiens; identical to SEQ ID NO: 553247
  misc_feature: HIJSMM301AGKDW.40.57.F02.1.454.light.4.raw

SEQ ID NO: 566042 - DNA, 472 bp, Homo sapiens
  misc_feature: HIJSMM301C1BG4.4.75.G09.1.454.light.4.raw
agcactgtagcacgaccggtgctcgatttagtatagacatcaggggctgggcctcaggaagcagcatcggaggtgcctcagccatggcatggatccctctcttcctcgtcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagacccg

SEQ ID NO: 566043 - DNA, 505 bp, Homo sapiens
  misc_feature: HIJSMM301B4XZP.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggacggaccaaggtcgaccgtcctaggtcagcccaaggctcgccccccg

SEQ ID NO: 566044 - DNA, 489 bp, Homo sapiens; identical to SEQ ID NO: 535139
  misc_feature: HIJSMM301CLGUJ.14.55.E11.1.454.light.4.raw

SEQ ID NO: 566045 - DNA, 494 bp, Homo sapiens; identical to SEQ ID NO: 536974
  misc_feature: HIJSMM301BHSG3.16.86.H09.1.454.light.4.raw

SEQ ID NO: 566046 - DNA, 495 bp, Homo sapiens
  misc_feature: HIJSMM301D0KCV.11.21.B10.1.454.light.4.raw
cgagagataccacgaccggtgctcgatttagtgtcgtcgcaagagaggaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatt

SEQ ID NO: 566047 - DNA, 490 bp, Homo sapiens
  misc_feature: HIJSMM301D1N2T.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgtgggtttgttctccatgcaaggtacacactggccttttggccaggggaccaacctggagatcaaatgaactgtggctgcaccatctgtctt

SEQ ID NO: 566048 - DNA, 499 bp, Homo sapiens
  misc_feature: HIJSMM301DKATX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcgtctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtctt

SEQ ID NO: 566049 - DNA, 499 bp, Homo sapiens
  misc_feature: HIJSMM301BJ1QQ.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaaacaaatatggaacagtttttaccctcacaactcatatcacagaatctgaggatgctgcattttacttcggtctacaacatgataatttccctccgtggacgttcggccaagggaccaaggagcaaatcaaacgaactagtggctgcaccatctgtcttcatcttcccgccat

SEQ ID NO: 566050 - DNA, 518 bp, Homo sapiens
  misc_feature: HIJSMM301BYDLM.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgagggtgactatttctgtcaagtgtgggacaccaacacttgtgtcttcgggactgggaccgaggtcaccgtcctaaggtcagcccagggccaaccccactgtcactctgttcccaccctcctcgacacg

SEQ ID NO: 566051 - DNA, 521 bp, Homo sapiens; identical to SEQ ID NO: 562813
  misc_feature: HIJSMM301EN88O.10.86.H09.1.454.light.4.raw

SEQ ID NO: 566052 - DNA, 515 bp, Homo sapiens
  misc_feature: HIJSMM301ARQ06.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctcgttcccgccctcctcgagtagtaca

SEQ ID NO: 566053 - DNA, 490 bp, Homo sapiens; identical to SEQ ID NO: 535234
  misc_feature: HIJSMM301A8HEW.17.21.B10.1.454.light.4.raw

SEQ ID NO: 566054 - DNA, 482 bp, Homo sapiens
  misc_feature: HIJSMM301C9A63.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgataagtctcccgctcactttcggtcgggggaccgaaggtaggaggatcaagcgaactgtggctgcaccaa

SEQ ID NO: 566055 - DNA, 444 bp, Homo sapiens; identical to SEQ ID NO: 534993
  misc_feature: HIJSMM301D4W3I.5.9.A09.1.454.light.4.raw

SEQ ID NO: 566056 - DNA, 479 bp, Homo sapiens
  misc_feature: HIJSMM301DSX79.16.4.A04.1.454.light.4.raw
tgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtcccatcaagattcagcggcagtggatctgggacagagttcactctcaccatcagcagcctgcagcctgatgattttgcaacctattattgccaacagtataatagttatccgtggacgttcggccaagggaccgagggtaggacatcaaacgaacctagtggctgcacca

SEQ ID NO: 566057 - DNA, 505 bp, Homo sapiens
  misc_feature: HIJSMM301DOB2R.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtccta

SEQ ID NO: 566058 - DNA, 486 bp, Homo sapiens; identical to SEQ ID NO: 535385
  misc_feature: HIJSMM301ANLOM.19.71.G05.1.454.light.4.raw

SEQ ID NO: 566059 - DNA, 480 bp, Homo sapiens; identical to SEQ ID NO: 551737
  misc_feature: HIJSMM301DDBSZ.21.25.C03.1.454.light.4.raw

SEQ ID NO: 566060 - DNA, 488 bp, Homo sapiens
  misc_feature: HIJSMM301CZYBS.16.2.A02.1.454.light.4.raw
tgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaagagccaccctctcctgcagggccagtcagagtgttagcagcttcttagcctggtaccagcagagacctggccaggctcccagactcctcatctatgatgcatccaacagggccactggcatcccagccaggttcagtggcagtgggtctgggacagacttcactctcaccatcagcagcctagagcctgaagattctgcaatttattactgtcagcagagtaacaactggcctccgctcactttcggcggagggccaaggtggagatcgaacgaactgtggctgcaccatctgtctt

SEQ ID NO: 566061 - DNA, 497 bp, Homo sapiens
  misc_feature: HIJSMM301EK048.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcggggggaccgaaacgtgaccgtcctacggtcagcccaaggctgccccctcggtcactctcgtt

SEQ ID NO: 566062 - DNA, 503 bp, Homo sapiens
  misc_feature: HIJSMM301DTLZY.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggcaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 566063 - DNA, 509 bp, Homo sapiens; identical to SEQ ID NO: 539359
  misc_feature: HIJSMM301ALXYU.47.85.H08.1.454.light.4.raw

SEQ ID NO: 566064 - DNA, 465 bp, Homo sapiens
  misc_feature: HIJSMM301BDM4R.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgtgcaacttattactgtcaaagaatagcgctgccccgctcagtttcggcggagggaccaaggtggagatacg

SEQ ID NO: 566065 - DNA, 472 bp, Homo sapiens; identical to SEQ ID NO: 536302
  misc_feature: HIJSMM301EPXUT.18.76.G10.1.454.light.4.raw

SEQ ID NO: 566066 - DNA, 473 bp, Homo sapiens
  misc_feature: HIJSMM301B0VTV.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaaagtggatatcaaacgaactgtggctgcaccatctgtcttcatcttcccgccat

SEQ ID NO: 566067 - DNA, 486 bp, Homo sapiens
  misc_feature: HIJSMM301DZ935.14.55.E11.1.454.light.4.raw
  modified_base (482)..(482): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcgagatcagacgaactgtggctgcaccatctgtnttcc

SEQ ID NO: 566068 - DNA, 501 bp, Homo sapiens; identical to SEQ ID NO: 555551
  misc_feature: HIJSMM301EEITN.21.81.H04.1.454.light.4.raw

SEQ ID NO: 566069 - DNA, 498 bp, Homo sapiens
  misc_feature: HIJSMM301D8O9D.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttatacctttcctcggactttcggtccctcgggtaccgacgaagtggagtgttcaaacgaaactagt

SEQ ID NO: 566070 - DNA, 497 bp, Homo sapiens; identical to SEQ ID NO: 538030
  misc_feature: HIJSMM301BQ282.40.23.C01.1.454.light.4.raw

SEQ ID NO: 566071 - DNA, 488 bp, Homo sapiens
  misc_feature: HIJSMM301CFFVR.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacgg

SEQ ID NO: 566072 - DNA, 517 bp, Homo sapiens; identical to SEQ ID NO: 536980
  misc_feature: HIJSMM301ETM1J.5.27.C05.1.454.light.4.raw

SEQ ID NO: 566073 - DNA, 485 bp, Homo sapiens
  misc_feature: HIJSMM301DJTBA.40.15.B04.1.454.light.4.raw
tctagcgactcacgaccggtgctcgatttagacagtatatatccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccaagctgaccgtcctaggtcagaccccg

SEQ ID NO: 566074 - DNA, 493 bp, Homo sapiens; identical to SEQ ID NO: 535047
  misc_feature: HIJSMM301CV20Q.16.53.E09.1.454.light.4.raw

SEQ ID NO: 566075 - DNA, 490 bp, Homo sapiens; identical to SEQ ID NO: 535234
  misc_feature: HIJSMM301CKEXD.17.21.B10.1.454.light.4.raw

SEQ ID NO: 566076 - DNA, 494 bp, Homo sapiens; identical to SEQ ID NO: 534992
  misc_feature: HIJSMM301B6OSL.9.1.A01.1.454.light.4.raw

SEQ ID NO: 566077 - DNA, 492 bp, Homo sapiens
  misc_feature: HIJSMM301C5G88.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcagtgggtctgggacagacttcactctcaccatcagcaacctagagcctgaagactttgcagtttatactgtcagcagcgtagtaagtggcgcttcggccaagggacacgactggaggttaaacgaactgtggctgcaccatctgtcttcatcttcccgccat

SEQ ID NO: 566078 - DNA, 460 bp, Homo sapiens; identical to SEQ ID NO: 537107
  misc_feature: HIJSMM301AVNP9.22.28.C06.1.454.light.4.raw

SEQ ID NO: 566079 - DNA, 494 bp, Homo sapiens
  misc_feature: HIJSMM301EBLQZ.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattccggccctgggaccaaagtggagatacaaacgaactgtgg

SEQ ID NO: 566080 - DNA, 486 bp, Homo sapiens; identical to SEQ ID NO: 535290
  misc_feature: HIJSMM301BWG4X.3.12.B01.1.454.light.4.raw

SEQ ID NO: 566081 - DNA, 512 bp, Homo sapiens; identical to SEQ ID NO: 541300
  misc_feature: HIJSMM301A4KV1.17.33.C11.1.454.light.4.raw

SEQ ID NO: 566082 - DNA, 447 bp, Homo sapiens; identical to SEQ ID NO: 535201
  misc_feature: HIJSMM301CEW64.18.9.A09.1.454.light.4.raw

SEQ ID NO: 566083 - DNA, 506 bp, Homo sapiens
  misc_feature: HIJSMM301BUZK9.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactagtggctgcaccatctgtcttctactcttcccgccca

SEQ ID NO: 566084 - DNA, 484 bp, Homo sapiens; identical to SEQ ID NO: 536162
  misc_feature: HIJSMM301B7XDR.13.59.F04.1.454.light.4.raw

SEQ ID NO: 566085 - DNA, 505 bp, Homo sapiens
  misc_feature: HIJSMM301E02U4.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaaccccactgtca

SEQ ID NO: 566086 - DNA, 508 bp, Homo sapiens
  misc_feature: HIJSMM301EIS08.19.67.G01.1.454.light.4.raw
  modified_base (456)..(456): a, c, t, g, unknown or other
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgccctccctcaccatctctggactgaagactggaggacgaggctgactactactgtcagtcttatgatagccgcggtcatgtggtcttcggngggacgggaccaagcgtgacccgtcctaggtcacgccaaggctcgccccctc

SEQ ID NO: 566087 - DNA, 445 bp, Homo sapiens
  misc_feature: HIJSMM301EY49M.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgatttattactgccactcctatgacaacagcctgagtatttggctgttcggcggcgggaccaagttgaccgtcctacgtcagcccaaggctgccccctcggtcactctgttcccaccctcctccactactatg

SEQ ID NO: 566088 - DNA, 503 bp, Homo sapiens
  misc_feature: HIJSMM301B23R9.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcat

SEQ ID NO: 566089 - DNA, 520 bp, Homo sapiens; identical to SEQ ID NO: 535773
  misc_feature: HIJSMM301DX82D.41.19.B08.1.454.light.4.raw

SEQ ID NO: 566090 - DNA, 483 bp, Homo sapiens
  misc_feature: HIJSMM301AS43S.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctacttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggtcggaggaccgaagtggagatcaaacgaa

SEQ ID NO: 566091 - DNA, 485 bp, Homo sapiens
  misc_feature: HIJSMM301AXSNI.26.45.E01.1.454.light.4.raw
agactatactcacgaccggtgctcgatttagtgagtcagtaaggggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtcctgacaggttcagtggcagtggatcagacacagattttacactgaaaatcagtagagtggaggctgaggatgttggagtttattactgcatgcaagctctacaaactcctctcactttcggcggaggaccaacggtggagatcaaacgaact

SEQ ID NO: 566092 - DNA, 482 bp, Homo sapiens; identical to SEQ ID NO: 537205
  misc_feature: HIJSMM301ELBCX.5.39.D06.1.454.light.4.raw

SEQ ID NO: 566093 - DNA, 491 bp, Homo sapiens
  misc_feature: HIJSMM301BJZ6W.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtgggctgcaccta

SEQ ID NO: 566094 - DNA, 486 bp, Homo sapiens
  misc_feature: HIJSMM301CJ848.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcagagggaccaaggcggagatcagacgaactgtggctgcaccatctgtctt

SEQ ID NO: 566095 - DNA, 498 bp, Homo sapiens; identical to SEQ ID NO: 535295
  misc_feature: HIJSMM301CP5JH.15.25.C03.1.454.light.4.raw

SEQ ID NO: 566096 - DNA, 468 bp, Homo sapiens
  misc_feature: HIJSMM301B3R7Z.51.34.D01.1.454.light.4.raw
cgatcgtatacacgaccggtgctcgatttagatcgtctgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaccagggacagcccctaaactcctgatcctcgatgcatccactttggaaacaggggtcccatcaaggttcagtggaagtggctctgggacagattttactttctaccatcagcaggctgcagcctgaagacattgcaacatattactgtcaacagtatgatagtctccgctcactttcggcgggggaccgaaggtggagatcaagcgaa

SEQ ID NO: 566097 - DNA, 496 bp, Homo sapiens
  misc_feature: HIJSMM301CRYQD.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccg

SEQ ID NO: 566098 - DNA, 504 bp, Homo sapiens
  misc_feature: HIJSMM301COM6W.40.53.E09.1.454.light.4.raw
tctagcgactcacgaccggtgctcgatttagagagagtgtgttgggtttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggtcagagggtcaccatctcttgttctggaagcagatccaacatcggaagtaatactgtaaactggtaccagcagctcccacggaacggcccccaaactcctcatctatgataatagtcaccggccctcaggggtacctgaccgattctctggctccaagtctggcacctcagcctccctggccatcacgtgggctccagtctgaggatgaggctgattatcactgtgcatcctgggatgacagcctgaatggttgggtgttcggcggggggaccgaagctgaccgtcctaagtcagccaac

SEQ ID NO: 566099 - DNA, 482 bp, Homo sapiens
  misc_feature: HIJSMM301DKR32.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcagtttattactgtcagcagtataattactggctcgtttttggccaggggaccaagctggagatcaagcgaactgtggctgcaccat

SEQ ID NO: 566100 - DNA, 500 bp, Homo sapiens
  misc_feature: HIJSMM301EIC7S.17.27.C05.1.454.light.4.raw
  modified_base (422)..(422): a, c, t, g, unknown or other
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgcccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccggganagcagtgctgaccaggtgtattcggcggaggacccactgaccgtcttaggtcagcccaaggctgccccctcggtctac

SEQ ID NO: 566101 - DNA, 480 bp, Homo sapiens; identical to SEQ ID NO: 540928
  misc_feature: HIJSMM301DYFBK.43.7.A07.1.454.light.4.raw

SEQ ID NO: 566102 - DNA, 500 bp, Homo sapiens
  misc_feature: HIJSMM301EO8HY.53.30.C08.1.454.light.4.raw
  modified_base (465)..(465): a, c, t, g, unknown or other
cgcgtatacacacgaccggtgctcgatttagtctgacgtcaaagggaaagggggggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccngggtcagccaaggccaaccccactgtcactctgtt

SEQ ID NO: 566103 - DNA, 516 bp, Homo sapiens
  misc_feature: HIJSMM301AOXU9.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgccctcct

SEQ ID NO: 566104 - DNA, 511 bp, Homo sapiens
  misc_feature: HIJSMM301DB58N.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaaggctgaccgtcctcggtcagcccaaggctgccccctcggt

SEQ ID NO: 566105 - DNA, 491 bp, Homo sapiens; identical to SEQ ID NO: 536211
  misc_feature: HIJSMM301CS4UV.16.53.E09.1.454.light.4.raw

SEQ ID NO: 566106 - DNA, 494 bp, Homo sapiens; identical to SEQ ID NO: 536974
  misc_feature: HIJSMM301BSOS2.16.86.H09.1.454.light.4.raw

SEQ ID NO: 566107 - DNA, 490 bp, Homo sapiens
  misc_feature: HIJSMM301A3QCR.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtccctcaaggttcagtggcagtggatctgggacagatttcactctcaccatccgcggtctgcaacctgaagatttcgcaacttactactgtcaacagacttacagtcgccccccgatcaccttcggccaagggacacgactggagattaaacgaactgtggctgcaccatctgtcttcatt

SEQ ID NO: 566108 - DNA, 501 bp, Homo sapiens; identical to SEQ ID NO: 565739
  misc_feature: HIJSMM301D7N19.14.3.A03.1.454.light.4.raw

SEQ ID NO: 566109 - DNA, 497 bp, Homo sapiens; identical to SEQ ID NO: 546781
  misc_feature: HIJSMM301C0PHM.43.28.C06.1.454.light.4.raw

SEQ ID NO: 566110 - DNA, 504 bp, Homo sapiens
  misc_feature: HIJSMM301A0UAN.41.37.D04.1.454.light.4.raw
tctatactatcacgaccggtgctcgatttagtagcatactgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 566111 - DNA, 485 bp, Homo sapiens
  misc_feature: HIJSMM301A4AKQ.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatagagacgaactgtggctgcaccatctgtctt

SEQ ID NO: 566112 - DNA, 502 bp, Homo sapiens; identical to SEQ ID NO: 541971
  misc_feature: HIJSMM301C401V.4.39.D06.1.454.light.4.raw

SEQ ID NO: 566113 - DNA, 487 bp, Homo sapiens; identical to SEQ ID NO: 537573
  misc_feature: HIJSMM301AWY89.3.10.A10.1.454.light.4.raw

SEQ ID NO: 566114 - DNA, 484 bp, Homo sapiens; identical to SEQ ID NO: 540489
  misc_feature: HIJSMM301BLPTX.7.75.G09.1.454.light.4.raw

SEQ ID NO: 566115 - DNA, 503 bp, Homo sapiens; identical to SEQ ID NO: 535044
  misc_feature: HIJSMM301DU4IA.19.78.H01.1.454.light.4.raw

SEQ ID NO: 566116 - DNA, 493 bp, Homo sapiens; identical to SEQ ID NO: 535084
  misc_feature: HIJSMM301DED5R.47.64.F09.1.454.light.4.raw

SEQ ID NO: 566117 - DNA, 507 bp, Homo sapiens
  misc_feature: HIJSMM301C2JLR.3.31.C09.1.454.light.4.raw
  modified_base (488)..(488): a, c, t, g, unknown or other
  modified_base (492)..(492): a, c, t, g, unknown or other
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcacttcgtcggacgggacgaacggagggaggaagagaacaaacgtactaaggngtgngaccatacctgtctt

SEQ ID NO: 566118 - DNA, 444 bp, Homo sapiens; identical to SEQ ID NO: 535594
  misc_feature: HIJSMM301EG3PS.9.9.A09.1.454.light.4.raw

SEQ ID NO: 566119 - DNA, 498 bp, Homo sapiens; identical to SEQ ID NO: 553891
  misc_feature: HIJSMM301CCEYG.3.33.C11.1.454.light.4.raw

SEQ ID NO: 566120 - DNA, 487 bp, Homo sapiens
  misc_feature: HIJSMM301AQIL7.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggaggaccaaggtggagatacaaacgaactgt

SEQ ID NO: 566121 - DNA, 497 bp, Homo sapiens
  misc_feature: HIJSMM301ASD2E.9.53.E09.1.454.light.4.raw
tgatacgtctcacgaccggtgctcgatttagagagagtgtgttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctc

SEQ ID NO: 566122 - DNA, 509 bp, Homo sapiens
  misc_feature: HIJSMM301DMZ2L.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgtcgccggggaccgaccgtcggaaatacaaacgaactagtggctgcaccatctgtctt

SEQ ID NO: 566123 - DNA, 511 bp, Homo sapiens
  misc_feature: HIJSMM301DOU1E.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgacgtcctaggtcagcccaaggctgccccctggtcactctgttcccg

SEQ ID NO: 566124 - DNA, 507 bp, Homo sapiens
  misc_feature: HIJSMM301BWBHV.4.21.B10.1.454.light.4.raw
agcactgtagcacgaccggtgctcgatttagtgtcgtcgcaagagagagagaggagggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactccg

SEQ ID NO: 566125 - DNA, 495 bp, Homo sapiens
  misc_feature: HIJSMM301DJZ1Z.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggaggatcaacgaactgtggctgcaccatctgtctt

SEQ ID NO: 566126 - DNA, 499 bp, Homo sapiens; identical to SEQ ID NO: 549363
  misc_feature: HIJSMM301DQVZJ.9.81.H04.1.454.light.4.raw

SEQ ID NO: 566127 - DNA, 478 bp, Homo sapiens
  misc_feature: HIJSMM301BGSG8.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcgagggaccaaggtgcagatcaaacgaactgtgg

SEQ ID NO: 566128 - DNA, 480 bp, Homo sapiens; identical to SEQ ID NO: 535291
  misc_feature: HIJSMM301C68L3.22.59.F04.1.454.light.4.raw

SEQ ID NO: 566129 - DNA, 475 bp, Homo sapiens; identical to SEQ ID NO: 542145
  misc_feature: HIJSMM301BZX7H.40.59.F04.1.454.light.4.raw

SEQ ID NO: 566130 - DNA, 454 bp, Homo sapiens; identical to SEQ ID NO: 535005
  misc_feature: HIJSMM301B00P2.19.86.H09.1.454.light.4.raw

SEQ ID NO: 566131 - DNA, 447 bp, Homo sapiens
  misc_feature: HIJSMM301A6G14.8.73.G07.1.454.light.4.raw
ctcgcgtgtccacgaccggtgctcgatttagctctacgctcagggtcctgggcccagtctgtactgacgcagccgccctcagtatctcggggccccagggcaggagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgccccctcggtcactctgttcccaccctcctcgacacgcgag

SEQ ID NO: 566132 - DNA, 516 bp, Homo sapiens
  misc_feature: HIJSMM301CSLM6.13.3.A03.1.454.light.4.raw
tcacgtactacacgaccggtgctcgatttagagagcgtcacaggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgtatttttactgttgttcatatgcaggaaggagtgattatgttctttggaagtgggaccaaggtcaccgtccttggtcagcccaaggccaaccccactgtcacttctcgttcccta

SEQ ID NO: 566133 - DNA, 446 bp, Homo sapiens; identical to SEQ ID NO: 537066
  misc_feature: HIJSMM301EDHWJ.18.9.A09.1.454.light.4.raw

SEQ ID NO: 566134 - DNA, 486 bp, Homo sapiens; identical to SEQ ID NO: 535385
  misc_feature: HIJSMM301AQ2C6.19.71.G05.1.454.light.4.raw

SEQ ID NO: 566135 - DNA, 478 bp, Homo sapiens
  misc_feature: HIJSMM301AL44A.49.85.H08.1.454.light.4.raw
agtcgagagacacgaccggtgctcgatttagtatcactcagtcgcgggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcacc

SEQ ID NO: 566136 - DNA, 509 bp, Homo sapiens
  misc_feature: HIJSMM301B4RF4.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggccctccctgaccgtctctggcctccagactgaggacgaggctgattattactgccactcatataagaagtagtactactcctgtggttttcggcggagggaccaagctgaccgtcctaggtcagcccaaggctcgccccctcggtcactct

SEQ ID NO: 566137 - DNA, 494 bp, Homo sapiens; identical to SEQ ID NO: 534994
  misc_feature: HIJSMM301CMHLD.27.78.H01.1.454.light.4.raw

SEQ ID NO: 566138 - DNA, 519 bp, Homo sapiens; identical to SEQ ID NO: 565099
  misc_feature: HIJSMM301EEYRK.53.65.F10.1.454.light.4.raw

SEQ ID NO: 566139 - DNA, 441 bp, Homo sapiens
  misc_feature: HIJSMM301BWQAL.4.75.G09.1.454.light.4.raw
agcactgtagcacgaccggtgctcgatttagtatagacatcaggggctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaaactgaccgtcctaggtcagcccaaggctgccccctcggtcactctgttcccaccctcctcctacagtgct

SEQ ID NO: 566140 - DNA, 504 bp, Homo sapiens; identical to SEQ ID NO: 544742
  misc_feature: HIJSMM301CKE8S.21.22.B11.1.454.light.4.raw

SEQ ID NO: 566141 - DNA, 514 bp, Homo sapiens
  misc_feature: HIJSMM301EWVXA.48.66.F11.1.454.light.4.raw
agtatacatacacgaccggtgctcgatttagtcacgcgagaaagggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttccca

SEQ ID NO: 566142 - DNA, 508 bp, Homo sapiens; identical to SEQ ID NO: 538771
  misc_feature: HIJSMM301DL0FG.8.33.C11.1.454.light.4.raw

SEQ ID NO: 566143 - DNA, 489 bp, Homo sapiens; identical to SEQ ID NO: 554384
  misc_feature: HIJSMM301BI6OB.40.33.C11.1.454.light.4.raw

SEQ ID NO: 566144 - DNA, 512 bp, Homo sapiens
  misc_feature: HIJSMM301D2K8Z.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcacgcccaaggcctcgccccctcggtccactcctcgttcccacccctcctt

SEQ ID NO: 566145 - DNA, 507 bp, Homo sapiens
  misc_feature: HIJSMM301A5U9R.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggttgttcggcggagggaccaaactgaccgtccgtaggtcagcccaaggctcgccccctcggtccactctgtt

SEQ ID NO: 566146 - DNA, 489 bp, Homo sapiens; identical to SEQ ID NO: 544582
  misc_feature: HIJSMM301DPND4.22.65.F10.1.454.light.4.raw

SEQ ID NO: 566147 - DNA, 444 bp, Homo sapiens; identical to SEQ ID NO: 537971
  misc_feature: HIJSMM301B8LZP.2.76.G10.1.454.light.4.raw

SEQ ID NO: 566148 - DNA, 495 bp, Homo sapiens
  misc_feature: HIJSMM301BKRJ0.51.38.D05.1.454.light.4.raw
cgatcgtatacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 566149 - DNA, 477 bp, Homo sapiens
  misc_feature: HIJSMM301D6UDX.49.63.F08.1.454.light.4.raw
agtcgagagacacgaccggtgctcgatttagcgatcgtataagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaagctggagatcacacgaactgtggctgcaccat

SEQ ID NO: 566150 - DNA, 503 bp, Homo sapiens; identical to SEQ ID NO: 537216
  misc_feature: HIJSMM301BBJ40.3.70.G04.1.454.light.4.raw

SEQ ID NO: 566151 - DNA, 483 bp, Homo sapiens; identical to SEQ ID NO: 544786
  misc_feature: HIJSMM301A2RSU.46.26.C04.1.454.light.4.raw

SEQ ID NO: 566152 - DNA, 489 bp, Homo sapiens
  misc_feature: HIJSMM301CCUBX.9.77.G11.1.454.light.4.raw
tgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcgtctagattagaaagtggggtcccatcaaggttcagcggcagccaatctgggacagacttcactctcaccatcaccagtctgcagcctgatgacttcgcaagttattactgccaacagtacagaatttatccgtggacattcggccaagggaccaaggtggaaatcaaacgaactgtggctgcaccatctgtt

SEQ ID NO: 566153 - DNA, 494 bp, Homo sapiens
  misc_feature: HIJSMM301CCLHQ.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccccgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacca

SEQ ID NO: 566154 - DNA, 505 bp, Homo sapiens
  misc_feature: HIJSMM301CRIL6.5.24.C02.1.454.light.4.raw
  modified_base (450)..(450): a, c, t, g, unknown or other
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctcctgaccgtctctggggctccaggctgaggatgaggctgattattactgcagctcatatgcaggcagcagcagtccccatgtnatcttcggcgggggaccaagctgaccgtcctaggtcagcccaaggctgccccccg

SEQ ID NO: 566155 - DNA, 501 bp, Homo sapiens
  misc_feature: HIJSMM301ALDAG.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaaccccactg

SEQ ID NO: 566156 - DNA, 521 bp, Homo sapiens; identical to SEQ ID NO: 539470
  misc_feature: HIJSMM301CMX7U.27.23.C01.1.454.light.4.raw

SEQ ID NO: 566157 - DNA, 518 bp, Homo sapiens; identical to SEQ ID NO: 542842
  misc_feature: HIJSMM301AGEXT.8.87.H10.1.454.light.4.raw

SEQ ID NO: 566158 - DNA, 524 bp, Homo sapiens
  misc_feature: HIJSMM301CUWNK.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggtcgggggaccgaagttaggaccgtccgtgggtcaggcccaacggctgccccctccggtccattcctcgttcccgcccctcccttcctagttacg

SEQ ID NO: 566159 - DNA, 494 bp, Homo sapiens; identical to SEQ ID NO: 534992
  misc_feature: HIJSMM301CRU1J.9.1.A01.1.454.light.4.raw

SEQ ID NO: 566160 - DNA, 465 bp, Homo sapiens
  misc_feature: HIJSMM301B1IY9.13.4.A04.1.454.light.4.raw
  modified_base (455)..(455): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctccgatcaccttcggccaagggacacgactgganattaaacgaa

SEQ ID NO: 566161 - DNA, 513 bp, Homo sapiens
  misc_feature: HIJSMM301CR618.8.39.D06.1.454.light.4.raw
ctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagttttactactgtcagcagtatgttacgtccccgtggacgttcggccaagggaccaaggtggcaatcaaccgaactgtggctgcaccatctgtcttcatcttcccgcc

SEQ ID NO: 566162 - DNA, 495 bp, Homo sapiens; identical to SEQ ID NO: 543631
  misc_feature: HIJSMM301AWVXA.11.59.F04.1.454.light.4.raw

SEQ ID NO: 566163 - DNA, 486 bp, Homo sapiens; identical to SEQ ID NO: 535043
  misc_feature: HIJSMM301D0TW1.46.35.D02.1.454.light.4.raw

SEQ ID NO: 566164 - DNA, 469 bp, Homo sapiens; identical to SEQ ID NO: 536091
  misc_feature: HIJSMM301BTLLJ.3.82.H05.1.454.light.4.raw

SEQ ID NO: 566165 - DNA, 512 bp, Homo sapiens
  misc_feature: HIJSMM301AR76B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccgaacggtaggaaagtacaaaacgaaactagtggctgcaccatctgtcttcatcttccccg

SEQ ID NO: 566166 - DNA, 494 bp, Homo sapiens; identical to SEQ ID NO: 534994
  misc_feature: HIJSMM301AOH1P.27.78.H01.1.454.light.4.raw

SEQ ID NO: 566167 - DNA, 505 bp, Homo sapiens; identical to SEQ ID NO: 535503
  misc_feature: HIJSMM301A67BZ.8.28.C06.1.454.light.4.raw

SEQ ID NO: 566168 - DNA, 500 bp, Homo sapiens
  misc_feature: HIJSMM301DITLM.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactagaaaatcagcagagtggaggctgaggacggttggggtttattactgcatgcaaggtctacaaaccccgatcaccttcggccgagggacacgcctggagattaaacgaactgtggctgcaccat

SEQ ID NO: 566169 - DNA, 489 bp, Homo sapiens; identical to SEQ ID NO: 536013
  misc_feature: HIJSMM301AK6BS.26.23.C01.1.454.light.4.raw

SEQ ID NO: 566170 - DNA, 502 bp, Homo sapiens
  misc_feature: HIJSMM301B4JS8.53.71.G05.1.454.light.4.raw
cgcgtatacacacgaccggtgctcgatttagtgtcgtcgcaagagagaggggggggtctcaggaggcagcgctctggggacgtctccaccatggcctgggctctgctcctccgcacctcctcactcagggcacaggctcttgggcccagtctgccctgattcagcctccctccgtgtccgggtctcctggacagtcagtcaccatctcctgcactggaaccagcagtgatgttgggggttatgactatgtctccttataacaacaccaaccaggcacagtccaagcccatgctctacaatgtcaattctcggccctcagggggccctgatcgtctctctggctccaagtctggcaatacggcctccatgaccatctctggactccaggctgaggacgatactgattattactcctgctcacaaacaagaagtgccaccttgggtcttcggcggagggaccaacctgaccgtcctaggtcagcccaagctgccccctcggtca

SEQ ID NO: 566171 - DNA, 478 bp, Homo sapiens
  misc_feature: HIJSMM301AZWGG.49.28.C06.1.454.light.4.raw
agtcgagagacacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccgaagtggagagtcaaacgaaactgtggc

SEQ ID NO: 566172 - DNA, 490 bp, Homo sapiens
  misc_feature: HIJSMM301D7D9X.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcaactttcggcggagggaccaaggcggagatcagacgaactgtggctgcaccatctgtcttcta

SEQ ID NO: 566173 - DNA, 508 bp, Homo sapiens; identical to SEQ ID NO: 552623
  misc_feature: HIJSMM301EKZNX.17.33.C11.1.454.light.4.raw

SEQ ID NO: 566174 - DNA, 380 bp, Homo sapiens
  misc_feature: HIJSMM301BEGR6.49.40.D07.1.454.light.4.raw
agtcgagagacacgaccggtgctcgatttagtgatagagcgtaacaacagaggggacagggtcagggcgctgagggtcagatgtcggtgtggggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaaggccacccctacacctcatcatatactgaggtcaggggctccccaggtggacaccaggactctgaccccctgcccctcatccaccccgcaggtcagcccaaggctgccccctcggtcactctgttcccgccctcctctctctcgact

SEQ ID NO: 566175 - DNA, 502 bp, Homo sapiens
  misc_feature: HIJSMM301DFTZX.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataattctgggtgttcggcggagggaccaaactgaaccgtcctaggtcagccaaggctgccccctcggtcactctgtt

SEQ ID NO: 566176 - DNA, 514 bp, Homo sapiens; identical to SEQ ID NO: 544770
  misc_feature: HIJSMM301CQJLG.16.66.F11.1.454.light.4.raw

SEQ ID NO: 566177 - DNA, 508 bp, Homo sapiens
  misc_feature: HIJSMM301BAVYZ.49.35.D02.1.454.light.4.raw
agtcgagagacacgaccggtgctcgatttagcacacgatagttgggtttgggggtgggtccaggaggcagaactctgggtgtctcaccatggcctggatccctctacttctccccctcctcactctctgcacaggctttgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggcggagggaccaggctgaccgtcctgggtcagcccaaggctgccccctcggtcactctgttccccg

SEQ ID NO: 566178 - DNA, 483 bp, Homo sapiens
  misc_feature: HIJSMM301AHWFF.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaaactcactttcggtccctcgggactgaagtagcatatgaagagaactagtggcgtgca

SEQ ID NO: 566179 - DNA, 487 bp, Homo sapiens; identical to SEQ ID NO: 541755
  misc_feature: HIJSMM301BQLP0.4.64.F09.1.454.light.4.raw

SEQ ID NO: 566180 - DNA, 488 bp, Homo sapiens; identical to SEQ ID NO: 535081
  misc_feature: HIJSMM301BK0XO.26.23.C01.1.454.light.4.raw

SEQ ID NO: 566181 - DNA, 496 bp, Homo sapiens; identical to SEQ ID NO: 535224
  misc_feature: HIJSMM301EVTSP.22.57.F02.1.454.light.4.raw

SEQ ID NO: 566182 - DNA, 493 bp, Homo sapiens; identical to SEQ ID NO: 535047
  misc_feature: HIJSMM301CFUSA.16.53.E09.1.454.light.4.raw

SEQ ID NO: 566183 - DNA, 516 bp, Homo sapiens
  misc_feature: HIJSMM301EEKQ1.49.23.C01.1.454.light.4.raw
agtcgagagacacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcgggcggcgggaccaaactgaccgtcctacgtcagcccaaggctgccccctcggtcactctcg

SEQ ID NO: 566184 - DNA, 480 bp, Homo sapiens; identical to SEQ ID NO: 535442
  misc_feature: HIJSMM301DKH6C.41.17.B06.1.454.light.4.raw

SEQ ID NO: 566185 - DNA, 512 bp, Homo sapiens
  misc_feature: HIJSMM301AZYH8.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagtagacgaactacgtggcgtggcaccactctgtcttctactcttcccgt

SEQ ID NO: 566186 - DNA, 501 bp, Homo sapiens
  misc_feature: HIJSMM301BB2RQ.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaggaccgaaggtaggaaagtacaaacgaactagtggctgcacca

SEQ ID NO: 566187 - DNA, 485 bp, Homo sapiens; identical to SEQ ID NO: 544950
  misc_feature: HIJSMM301ENZQD.10.2.A02.1.454.light.4.raw

SEQ ID NO: 566188 - DNA, 519 bp, Homo sapiens
  misc_feature: HIJSMM301BZT4O.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtcgacggaccgaacggtacggaaggtacgaaacgaactacgtggcgtgcgaccactctgtcttctactcttcccgtccact

SEQ ID NO: 566189 - DNA, 496 bp, Homo sapiens; identical to SEQ ID NO: 536828
  misc_feature: HIJSMM301B3XEH.3.71.G05.1.454.light.4.raw

SEQ ID NO: 566190 - DNA, 471 bp, Homo sapiens; identical to SEQ ID NO: 537461
  misc_feature: HIJSMM301CU2NE.7.81.H04.1.454.light.4.raw

SEQ ID NO: 566191 - DNA, 495 bp, Homo sapiens
  misc_feature: HIJSMM301BEQ22.49.33.C11.1.454.light.4.raw
agtcgagagacacgaccggtgctcgatttagagtgagctcgttggggtttggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggtcggagggaccgaaggtggaggatcaaacgaactagtggctgcaccat

SEQ ID NO: 566192 - DNA, 493 bp, Homo sapiens; identical to SEQ ID NO: 535084
  misc_feature: HIJSMM301B908M.47.64.F09.1.454.light.4.raw

SEQ ID NO: 566193 - DNA, 499 bp, Homo sapiens
  misc_feature: HIJSMM301BP2D1.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccaggctgaccgtcggcggtcagccaaggctgccccctcggtcactctcgttcccta

SEQ ID NO: 566194 - DNA, 491 bp, Homo sapiens
  misc_feature: HIJSMM301B3NRU.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaacggtggatctcaaaagaactgtggctgcacca

SEQ ID NO: 566195 - DNA, 479 bp, Homo sapiens; identical to SEQ ID NO: 537836
  misc_feature: HIJSMM301ATKA2.11.11.A11.1.454.light.4.raw

SEQ ID NO: 566196 - DNA, 476 bp, Homo sapiens
  misc_feature: HIJSMM301BSKWE.48.85.H08.1.454.light.4.raw
agtatacatacacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcct

SEQ ID NO: 566197 - DNA, 516 bp, Homo sapiens
  misc_feature: HIJSMM301CQO5U.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcacgcaaagcgggacccagaccctggagcctcagttggaagcagccgatccagcctgcggagcctgtggggcaggtcagcccaaggctgccccctcggtcactctgttcccaccctcctccacg

SEQ ID NO: 566198 - DNA, 507 bp, Homo sapiens; identical to SEQ ID NO: 556766
  misc_feature: HIJSMM301DMHFD.8.34.D01.1.454.light.4.raw

SEQ ID NO: 566199 - DNA, 497 bp, Homo sapiens
  misc_feature: HIJSMM301EV80N.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaaactgtggctgcaccatctgtcttcatt

SEQ ID NO: 566200 - DNA, 507 bp, Homo sapiens
  misc_feature: HIJSMM301BCEFP.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgtttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 566201 - DNA, 480 bp, Homo sapiens
  misc_feature: HIJSMM301A6VZM.48.28.C06.1.454.light.4.raw
agtatacatacacgaccggtgctcgatttagagctcacgtattgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagcccaac

SEQ ID NO: 566202 - DNA, 509 bp, Homo sapiens
  misc_feature: HIJSMM301BLC41.4.28.C06.1.454.light.4.raw
agcactgtagcacgaccggtgctcgatttagagctcacgtattgggtttggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctgggtcagcccaaggctgccccctcggtcactctcgttcccaccct

SEQ ID NO: 566203 - DNA, 495 bp, Homo sapiens
  misc_feature: HIJSMM301DW7LO.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaagtcaccgtcctgggtcagcccaaggccaaccccactgtcactctcg

SEQ ID NO: 566204 - DNA, 516 bp, Homo sapiens; identical to SEQ ID NO: 535549
  misc_feature: HIJSMM301ELPK5.14.70.G04.1.454.light.4.raw

SEQ ID NO: 566205 - DNA, 518 bp, Homo sapiens; identical to SEQ ID NO: 539372
  misc_feature: HIJSMM301CXK81.7.86.H09.1.454.light.4.raw

SEQ ID NO: 566206 - DNA, 507 bp, Homo sapiens
  misc_feature: HIJSMM301CKHA2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaacgaactagtggctgcaccatctgtcttctatcttccccg

SEQ ID NO: 566207 - DNA, 498 bp, Homo sapiens
  misc_feature: HIJSMM301DX5ZX.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttccctccgtggacgttcggccaagggaccaaaggagcaaatcaaacgaaactgtggctgcaccatctgtcttcatcttcccgccat

SEQ ID NO: 566208 - DNA, 519 bp, Homo sapiens
  misc_feature: HIJSMM301BPN5T.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaagtacgaaacgaacctagtggcgtgcaccactctgtcttcatcttcccgtcccact

SEQ ID NO: 566209 - DNA, 490 bp, Homo sapiens; identical to SEQ ID NO: 535936
  misc_feature: HIJSMM301CPRZ8.16.68.G02.1.454.light.4.raw

SEQ ID NO: 566210 - DNA, 500 bp, Homo sapiens
  misc_feature: HIJSMM301CXSHU.9.53.E09.1.454.light.4.raw
tgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgaactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctggt

SEQ ID NO: 566211 - DNA, 495 bp, Homo sapiens
  misc_feature: HIJSMM301CD5VT.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagccaagg

SEQ ID NO: 566212 - DNA, 522 bp, Homo sapiens
  misc_feature: HIJSMM301C2QFV.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgatttatgatgtcagtaatcgaccctcaggggtttctgatcgctttctttgcctccaagtctggcaacacggcctccctgaccatctcgtgggctccagactgaggacgaggctgattattactgcagctcacatacaagcggcaggcggttgggtggttcggcgggggaccacgactgaccgtcctacggtcagacccaaggctcgccccctcggtccactctcgtt

SEQ ID NO: 566213 - DNA, 471 bp, Homo sapiens
  misc_feature: HIJSMM301DTCBY.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcacctatcagcagtctgcaacctgaggattttgccacttactactgtcaacagacttacaataccctccatacacttttggccaggggaccaagctggagatcagacg

SEQ ID NO: 566214 - DNA, 484 bp, Homo sapiens; identical to SEQ ID NO: 536162
  misc_feature: HIJSMM301CI1FW.13.59.F04.1.454.light.4.raw

SEQ ID NO: 566215 - DNA, 481 bp, Homo sapiens; identical to SEQ ID NO: 535677
  misc_feature: HIJSMM301C7RVT.5.39.D06.1.454.light.4.raw

SEQ ID NO: 566216 - DNA, 480 bp, Homo sapiens
  misc_feature: HIJSMM301EDAZ8.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaagggtggagatcagacgaa

SEQ ID NO: 566217 - DNA, 447 bp, Homo sapiens; identical to SEQ ID NO: 535020
  misc_feature: HIJSMM301DQKOU.18.9.A09.1.454.light.4.raw

SEQ ID NO: 566218 - DNA, 415 bp, Homo sapiens; identical to SEQ ID NO: 535434
  misc_feature: HIJSMM301BFZVK.16.46.E02.1.454.light.4.raw

SEQ ID NO: 566219 - DNA, 491 bp, Homo sapiens; identical to SEQ ID NO: 563882
  misc_feature: HIJSMM301BXYOM.19.10.A10.1.454.light.4.raw

SEQ ID NO: 566220 - DNA, 484 bp, Homo sapiens; identical to SEQ ID NO: 535240
  misc_feature: HIJSMM301A2H6R.47.60.F05.1.454.light.4.raw

SEQ ID NO: 566221 - DNA, 415 bp, Homo sapiens; identical to SEQ ID NO: 536118
  misc_feature: HIJSMM301DY1HA.18.78.H01.1.454.light.4.raw

SEQ ID NO: 566222 - DNA, 403 bp, Homo sapiens
  misc_feature: HIJSMM301B8TXS.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccgccctcctcctacatgct

SEQ ID NO: 566223 - DNA, 515 bp, Homo sapiens
  misc_feature: HIJSMM301EGF5Y.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtcaaacgaactacgtggctgcaccatctgtcttctatcttcccgtccact

SEQ ID NO: 566224 - DNA, 525 bp, Homo sapiens
  misc_feature: HIJSMM301DM9TV.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacgc

SEQ ID NO: 566225 - DNA, 488 bp, Homo sapiens; identical to SEQ ID NO: 535861
  misc_feature: HIJSMM301BP1BA.14.55.E11.1.454.light.4.raw

SEQ ID NO: 566226 - DNA, 454 bp, Homo sapiens; identical to SEQ ID NO: 534964
  misc_feature: HIJSMM301AJPG0.19.86.H09.1.454.light.4.raw

SEQ ID NO: 566227 - DNA, 501 bp, Homo sapiens
  misc_feature: HIJSMM301CPQQA.10.33.C11.1.454.light.4.raw
catagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatttgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatcttccccg

SEQ ID NO: 566228 - DNA, 495 bp, Homo sapiens; identical to SEQ ID NO: 538651
  misc_feature: HIJSMM301BWN3Y.10.79.H02.1.454.light.4.raw

SEQ ID NO: 566229 - DNA, 495 bp, Homo sapiens
  misc_feature: HIJSMM301BSQ1L.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaatggggtcccacgaaggttcagtggaggtggagctgggacagattttaccctcaccatcagcagcctgcagcctgaagatcttgcaacatattactgtcaacagtataataatctcccgtacacttttggccagggaccaagctggagatcaaacgaactgtggctgcaccatctgtcttca

SEQ ID NO: 566230 - DNA, 497 bp, Homo sapiens; identical to SEQ ID NO: 535664
  misc_feature: HIJSMM301BMF7B.22.14.B03.1.454.light.4.raw

SEQ ID NO: 566231 - DNA, 477 bp, Homo sapiens; identical to SEQ ID NO: 537678
  misc_feature: HIJSMM301DVCPD.12.1.A01.1.454.light.4.raw

SEQ ID NO: 566232 - DNA, 491 bp, Homo sapiens; identical to SEQ ID NO: 554635
  misc_feature: HIJSMM301END7C.43.33.C11.1.454.light.4.raw

SEQ ID NO: 566233 - DNA, 487 bp, Homo sapiens; identical to SEQ ID NO: 544897
  misc_feature: HIJSMM301DBOV0.46.35.D02.1.454.light.4.raw

SEQ ID NO: 566234 - DNA, 502 bp, Homo sapiens
  misc_feature: HIJSMM301BFHPI.43.34.D01.1.454.light.4.raw
tgtgagtagtcacgaccggtgctcgatttagatcgtctgtgttgggtttgggggggcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggggacacggtcaccgtcctaggtcagcccaaggccaaacccccta

SEQ ID NO: 566235 - DNA, 492 bp, Homo sapiens; identical to SEQ ID NO: 536010
  misc_feature: HIJSMM301A435G.10.20.B09.1.454.light.4.raw

SEQ ID NO: 566236 - DNA, 492 bp, Homo sapiens
  misc_feature: HIJSMM301D277R.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtatttactttcaccatcagcagcctgcagcctagaagatattgacaacatattactgtacaacagtatcataactctcccctactttccggccctggaccaagtaggatatacaaacgaactgtggctgcacactctgtt

SEQ ID NO: 566237 - DNA, 503 bp, Homo sapiens
  misc_feature: HIJSMM301CGOQH.7.31.C09.1.454.light.4.raw
cgtgtctctacacgaccggtgctcgatttagacgtctcatcaaggaaggaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctcc

SEQ ID NO: 566238 - DNA, 473 bp, Homo sapiens
  misc_feature: HIJSMM301CX1WC.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcagcccg

SEQ ID NO: 566239 - DNA, 494 bp, Homo sapiens; identical to SEQ ID NO: 535276
  misc_feature: HIJSMM301BP2OL.16.6.A06.1.454.light.4.raw

SEQ ID NO: 566240 - DNA, 493 bp, Homo sapiens
  misc_feature: HIJSMM301EPRZ3.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagttcgctctcgaagtgttcggcggagggaccgagctgaccgtcctacgtcagcccaa

SEQ ID NO: 566241 - DNA, 501 bp, Homo sapiens
  misc_feature: HIJSMM301D1110.18.78.H01.1.454.light.4.raw
  modified_base (320)..(320): a, c, t, g, unknown or other
  modified_base (414)..(414): a, c, t, g, unknown or other
tacgagtatgcacgaccggtgctcgatttagtgtgagtagtttgggtttgggggggtctcaggaggcagcgctctcgggacgtctccaccatggcctaggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctnaggggtttctaatcgcttctctggctccaagtctggcaacacggcctcctgaccatctctgggctccaggctgaggacgaggctgattattacngcagctcatatacaagcagcagcatcaagtcttcggaactgggaccaaggtcaccgtcctaggtcagcccaaggccaacccatgtca

SEQ ID NO: 566242 - DNA, 476 bp, Homo sapiens; identical to SEQ ID NO: 538611
  misc_feature: HIJSMM301EA4H7.7.81.H04.1.454.light.4.raw

SEQ ID NO: 566243 - DNA, 516 bp, Homo sapiens; identical to SEQ ID NO: 535549
  misc_feature: HIJSMM301B5D25.14.70.G04.1.454.light.4.raw

SEQ ID NO: 566244 - DNA, 501 bp, Homo sapiens
  misc_feature: HIJSMM301DDVM3.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactc

SEQ ID NO: 566245 - DNA, 500 bp, Homo sapiens; identical to SEQ ID NO: 544063
  misc_feature: HIJSMM301D3EKR.12.18.B07.1.454.light.4.raw

SEQ ID NO: 566246 - DNA, 496 bp, Homo sapiens
  misc_feature: HIJSMM301D0O2H.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaaactgtggctgcaccatctgtcttcatcttccccg

SEQ ID NO: 566247 - DNA, 518 bp, Homo sapiens
  misc_feature: HIJSMM301BKAOZ.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcagactccctcgttggggcaaagctgccctgacccttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcg

SEQ ID NO: 566248 - DNA, 500 bp, Homo sapiens; identical to SEQ ID NO: 550395
  misc_feature: HIJSMM301BL6LF.15.56.F01.1.454.light.4.raw

SEQ ID NO: 566249 - DNA, 486 bp, Homo sapiens; identical to SEQ ID NO: 535043
  misc_feature: HIJSMM301AKZKP.46.35.D02.1.454.light.4.raw

SEQ ID NO: 566250 - DNA, 475 bp, Homo sapiens
  misc_feature: HIJSMM301A08LU.40.52.E08.1.454.light.4.raw
tctagcgactcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctgaccgt

SEQ ID NO: 566251 - DNA, 494 bp, Homo sapiens; identical to SEQ ID NO: 534994
  misc_feature: HIJSMM301CSLFO.27.78.H01.1.454.light.4.raw

SEQ ID NO: 566252 - DNA, 513 bp, Homo sapiens; identical to SEQ ID NO: 535719
  misc_feature: HIJSMM301EGRTY.17.33.C11.1.454.light.4.raw

SEQ ID NO: 566253 - DNA, 485 bp, Homo sapiens
  misc_feature: HIJSMM301DLVE3.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcgggcggagggaccaaggttgaccgtctaggtcagcccaaggctcg

SEQ ID NO: 566254 - DNA, 494 bp, Homo sapiens; identical to SEQ ID NO: 542264
  misc_feature: HIJSMM301EQMNW.13.6.A06.1.454.light.4.raw

SEQ ID NO: 566255 - DNA, 503 bp, Homo sapiens; identical to SEQ ID NO: 549080
  misc_feature: HIJSMM301DFA58.53.49.E05.1.454.light.4.raw

SEQ ID NO: 566256 - DNA, 492 bp, Homo sapiens; identical to SEQ ID NO: 535126
  misc_feature: HIJSMM301A48TP.18.11.A11.1.454.light.4.raw

SEQ ID NO: 566257 - DNA, 490 bp, Homo sapiens
  misc_feature: HIJSMM301CIZF0.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgacgtcctaggtcagcccaaggctgcccctcgg

SEQ ID NO: 566258 - DNA, 485 bp, Homo sapiens
  misc_feature: HIJSMM301EC8G9.52.37.D04.1.454.light.4.raw
cgcagtacgacacgaccggtgctcgatttagtagcatactgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtctt

SEQ ID NO: 566259 - DNA, 518 bp, Homo sapiens
  misc_feature: HIJSMM301BTJDR.49.82.H05.1.454.light.4.raw
agtcgagagacacgaccggtgctcgatttagtcgagctctctcgcgggcacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcacg

SEQ ID NO: 566260 - DNA, 503 bp, Homo sapiens
  misc_feature: HIJSMM301EWPDP.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggcctgccccctcggtcta

SEQ ID NO: 566261 - DNA, 479 bp, Homo sapiens; identical to SEQ ID NO: 538892
  misc_feature: HIJSMM301B04I3.22.59.F04.1.454.light.4.raw

SEQ ID NO: 566262 - DNA, 506 bp, Homo sapiens
  misc_feature: HIJSMM301EPAIW.10.27.C05.1.454.light.4.raw
catagtagtgcacgaccggtgctcgatttagacgcgatcgaagggtttgggggctggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgcccccc

SEQ ID NO: 566263 - DNA, 495 bp, Homo sapiens
  misc_feature: HIJSMM301DDY3L.51.35.D02.1.454.light.4.raw
cgatcgtatacacgaccggtgctcgatttagcacacgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgt

SEQ ID NO: 566264 - DNA, 489 bp, Homo sapiens; identical to SEQ ID NO: 542052
  misc_feature: HIJSMM301CUY1L.10.77.G11.1.454.light.4.raw

SEQ ID NO: 566265 - DNA, 521 bp, Homo sapiens; identical to SEQ ID NO: 538715
  misc_feature: HIJSMM301CAQQH.27.23.C01.1.454.light.4.raw

SEQ ID NO: 566266 - DNA, 501 bp, Homo sapiens
  misc_feature: HIJSMM301DBDOX.49.73.G07.1.454.light.4.raw
  modified_base (485)..(485): a, c, t, g, unknown or other
agtcgagagacacgaccggtgctcgatttagctctacgctcagggcacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcaggtgggtttgggacagacttcacgctcaccatcagcagcctagagcctgaagattttgctagtttattactgtcaacagcgtaccacaggattcactttcggccccggtcggacgagngtagatataacaaact

SEQ ID NO: 566267 - DNA, 516 bp, Homo sapiens
  misc_feature: HIJSMM301D9EOO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcgtccgacgggacgaacggtaggaagtacgaacgaactagtggctgcaccatctgtcttctatcttcccgtccatctgtat

SEQ ID NO: 566268 - DNA, 503 bp, Homo sapiens; identical to SEQ ID NO: 546075
  misc_feature: HIJSMM301D6NJR.7.71.G05.1.454.light.4.raw

SEQ ID NO: 566269 - DNA, 508 bp, Homo sapiens
  misc_feature: HIJSMM301DMFD1.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaacccactgtcactctgttccc

SEQ ID NO: 566270 - DNA, 416 bp, Homo sapiens; identical to SEQ ID NO: 545902
  misc_feature: HIJSMM301D7I12.18.78.H01.1.454.light.4.raw

SEQ ID NO: 566271 - DNA, 494 bp, Homo sapiens
  misc_feature: HIJSMM301CF4U2.10.72.G06.1.454.light.4.raw
catagtagtgcacgaccggtgctcgatttagctacgactgcaagggaaaggggggggtcgtcaggaggcagcgctctcgggacggtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 566272 - DNA, 506 bp, Homo sapiens; identical to SEQ ID NO: 534969
  misc_feature: HIJSMM301A6594.18.37.D04.1.454.light.4.raw

SEQ ID NO: 566273 - DNA, 488 bp, Homo sapiens; identical to SEQ ID NO: 536554
  misc_feature: HIJSMM301ALGL2.26.37.D04.1.454.light.4.raw

SEQ ID NO: 566274 - DNA, 518 bp, Homo sapiens; identical to SEQ ID NO: 563314
  misc_feature: HIJSMM301C0CR6.14.70.G04.1.454.light.4.raw

SEQ ID NO: 566275 - DNA, 505 bp, Homo sapiens; identical to SEQ ID NO: 535503
  misc_feature: HIJSMM301AIDZC.8.28.C06.1.454.light.4.raw

SEQ ID NO: 566276 - DNA, 492 bp, Homo sapiens; identical to SEQ ID NO: 539630
  misc_feature: HIJSMM301BICLP.22.25.C03.1.454.light.4.raw

SEQ ID NO: 566277 - DNA, 509 bp, Homo sapiens; identical to SEQ ID NO: 543772
  misc_feature: HIJSMM301AZ1CO.2.21.B10.1.454.light.4.raw

SEQ ID NO: 566278 - DNA, 486 bp, Homo sapiens; identical to SEQ ID NO: 535385
  misc_feature: HIJSMM301E0GJM.19.71.G05.1.454.light.4.raw

SEQ ID NO: 566279 - DNA, 490 bp, Homo sapiens; identical to SEQ ID NO: 541567
  misc_feature: HIJSMM301BYJ6H.22.65.F10.1.454.light.4.raw

SEQ ID NO: 566280 - DNA, 494 bp, Homo sapiens; identical to SEQ ID NO: 534994
  misc_feature: HIJSMM301ETE0L.27.78.H01.1.454.light.4.raw

SEQ ID NO: 566281 - DNA, 501 bp, Homo sapiens
  misc_feature: HIJSMM301D9NHB.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtctgggtcagcccaaggctgccccctcggtca

SEQ ID NO: 566282 - DNA, 504 bp, Homo sapiens
  misc_feature: HIJSMM301CB2J5.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctccccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaacgaactgtggctgcaccatctgtctt

SEQ ID NO: 566283 - DNA, 505 bp, Homo sapiens
  misc_feature: HIJSMM301C6CR7.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaaggctgaccgtcctaggtcagcccaaggctgccccctggtcactctgttcccaccctcctcg

SEQ ID NO: 566284 - DNA, 498 bp, Homo sapiens
  misc_feature: HIJSMM301BEPDZ.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactcc

SEQ ID NO: 566285 - DNA, 489 bp, Homo sapiens
  misc_feature: HIJSMM301ADHGJ.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaaggaccaagctggagatcaaacgaactgtggctgcaccta

SEQ ID NO: 566286 - DNA, 489 bp, Homo sapiens; identical to SEQ ID NO: 535139
  misc_feature: HIJSMM301A8D57.14.55.E11.1.454.light.4.raw

SEQ ID NO: 566287 - DNA, 476 bp, Homo sapiens; identical to SEQ ID NO: 538611
  misc_feature: HIJSMM301AXWH4.7.81.H04.1.454.light.4.raw

SEQ ID NO: 566288 - DNA, 484 bp, Homo sapiens; identical to SEQ ID NO: 536162
  misc_feature: HIJSMM301ECC3H.13.59.F04.1.454.light.4.raw

SEQ ID NO: 566289 - DNA, 483 bp, Homo sapiens; identical to SEQ ID NO: 537608
  misc_feature: HIJSMM301B60ZE.47.46.E02.1.454.light.4.raw

SEQ ID NO: 566290 - DNA, 503 bp, Homo sapiens; identical to SEQ ID NO: 551625
  misc_feature: HIJSMM301DLT3P.10.71.G05.1.454.light.4.raw

SEQ ID NO: 566291 - DNA, 504 bp, Homo sapiens
  misc_feature: HIJSMM301BQW3N.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggtcggagggaccaagctgaccgtcctaggtcagcccaaggctgccccctcggtcaactctgttcccaccctccctcgctacgtaga

SEQ ID NO: 566292 - DNA, 473 bp, Homo sapiens; identical to SEQ ID NO: 546369
  misc_feature: HIJSMM301DBXDW.18.76.G10.1.454.light.4.raw

SEQ ID NO: 566293 - DNA, 523 bp, Homo sapiens
  misc_feature: HIJSMM301CDIW9.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtcccgtcgaccggttctctggctccaagtctggctcttccgcctccttggccatcactgggctcgaggctgacgatgaggctgattactactgtctgtcctatgacgacgacctacagactccggttttcggtcggagggacgtaagctgaccggtcccttaagtcagcccaacggcgtcgccccctcccggtcgacctctcgttccccta

SEQ ID NO: 566294 - DNA, 484 bp, Homo sapiens; identical to SEQ ID NO: 535400
  misc_feature: HIJSMM301CXO8J.46.26.C04.1.454.light.4.raw

SEQ ID NO: 566295 - DNA, 518 bp, Homo sapiens; identical to SEQ ID NO: 539372
  misc_feature: HIJSMM301CYQ1N.7.86.H09.1.454.light.4.raw

SEQ ID NO: 566296 - DNA, 499 bp, Homo sapiens
  misc_feature: HIJSMM301BBT6Z.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagattttcactctcaccatcagcagcctgcaggctgaagatgtggcagtttattattgtcagcaatattatattcctcctcagacgttcggccaagggaccaaggtggaaatcaaacgaactgtggctgcaccta

SEQ ID NO: 566297 - DNA, 494 bp, Homo sapiens
  misc_feature: HIJSMM301BCYYB.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactctaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 566298 - DNA, 513 bp, Homo sapiens
  misc_feature: HIJSMM301EC1JJ.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctccttggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccct

SEQ ID NO: 566299 - DNA, 507 bp, Homo sapiens; identical to SEQ ID NO: 535641
  misc_feature: HIJSMM301AY4DV.10.88.H11.1.454.light.4.raw

SEQ ID NO: 566300 - DNA, 513 bp, Homo sapiens; identical to SEQ ID NO: 541387
  misc_feature: HIJSMM301DEDF7.17.33.C11.1.454.light.4.raw

SEQ ID NO: 566301 - DNA, 504 bp, Homo sapiens
  misc_feature: HIJSMM301A9BD5.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccccgacaatctctgggctccaggctgaggacgaggctgattattactgctgctcatatgcagatggtgacactcccgtggtattcggcggagggaccaaggtgaccgtcctaggtcagcccaaggctgccccctc

SEQ ID NO: 566302 - DNA, 479 bp, Homo sapiens; identical to SEQ ID NO: 539141
  misc_feature: HIJSMM301EHL5S.7.67.G01.1.454.light.4.raw

SEQ ID NO: 566303 - DNA, 500 bp, Homo sapiens; identical to SEQ ID NO: 564640
  misc_feature: HIJSMM301BQ3MF.43.71.G05.1.454.light.4.raw

SEQ ID NO: 566304 - DNA, 495 bp, Homo sapiens; identical to SEQ ID NO: 535486
  misc_feature: HIJSMM301BYX1Y.26.72.G06.1.454.light.4.raw

SEQ ID NO: 566305 - DNA, 493 bp, Homo sapiens; identical to SEQ ID NO: 535199
  misc_feature: HIJSMM301BRY5Z.16.86.H09.1.454.light.4.raw

SEQ ID NO: 566306 - DNA, 505 bp, Homo sapiens; identical to SEQ ID NO: 535503
  misc_feature: HIJSMM301AKK2G.8.28.C06.1.454.light.4.raw

SEQ ID NO: 566307 - DNA, 496 bp, Homo sapiens
  misc_feature: HIJSMM301D9F55.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggaccaagggaccaaggtggatatcagacgaactgtggctgca

SEQ ID NO: 566308 - DNA, 500 bp, Homo sapiens; identical to SEQ ID NO: 540219
  misc_feature: HIJSMM301EPWK6.43.34.D01.1.454.light.4.raw

SEQ ID NO: 566309 - DNA, 505 bp, Homo sapiens
  misc_feature: HIJSMM301AUB2A.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatctgt

SEQ ID NO: 566310 - DNA, 508 bp, Homo sapiens; identical to SEQ ID NO: 550253
  misc_feature: HIJSMM301A6HPD.9.55.E11.1.454.light.4.raw

SEQ ID NO: 566311 - DNA, 495 bp, Homo sapiens
  misc_feature: HIJSMM301CD7CG.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccagggaccgaaggtggagatcaaacgaaactgtggctgcaccatctgtcttcatcttcccg

SEQ ID NO: 566312 - DNA, 490 bp, Homo sapiens; identical to SEQ ID NO: 535526
  misc_feature: HIJSMM301CIVJE.26.78.H01.1.454.light.4.raw

SEQ ID NO: 566313 - DNA, 501 bp, Homo sapiens
  misc_feature: HIJSMM301A26BG.12.48.E04.1.454.light.4.raw
atacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtggttcggcggagggaccaagctgaccgtcctaggtcagcccaaggcag

SEQ ID NO: 566314 - DNA, 486 bp, Homo sapiens; identical to SEQ ID NO: 536323
  misc_feature: HIJSMM301AOLNG.10.2.A02.1.454.light.4.raw

SEQ ID NO: 566315 - DNA, 501 bp, Homo sapiens
  misc_feature: HIJSMM301AP20K.43.62.F07.1.454.light.4.raw
tgtgagtagtcacgaccggtgctcgatttagtagtcgcataaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacaagaaacccgtggacgttcggaccgaacgggaccgaaggtaggaaagacaagacgaactagtggctgcaccatctgtctttc

SEQ ID NO: 566316 - DNA, 521 bp, Homo sapiens
  misc_feature: HIJSMM301BXZJO.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccgttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactcttcgttccccacccttcctcgctaacg

SEQ ID NO: 566317 - DNA, 507 bp, Homo sapiens
  misc_feature: HIJSMM301DOUZK.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatggggatgacaatctgagcggttgggtgttcggcggagggaccaaactggacccgtcctaggtcaagcccaa

SEQ ID NO: 566318 - DNA, 505 bp, Homo sapiens
  misc_feature: HIJSMM301D8JPM.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactcattgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgtcctttatgtgggcgtggcatttgggtgttcggcggagggaccaaactgaccgtcctaggtcagcccaaggctgccccctcggtcact

SEQ ID NO: 566319 - DNA, 483 bp, Homo sapiens
  misc_feature: HIJSMM301BSB3K.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtcac

SEQ ID NO: 566320 - DNA, 498 bp, Homo sapiens
  misc_feature: HIJSMM301CSZUT.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactacgtggcgtcgcaccatctgtt

SEQ ID NO: 566321 - DNA, 487 bp, Homo sapiens
  misc_feature: HIJSMM301ALHEJ.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaacgggaccgaacggtggaaatacaaacgaactagtggctgcacc

SEQ ID NO: 566322 - DNA, 519 bp, Homo sapiens
  misc_feature: HIJSMM301CNEDB.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgttcaacagagttaccttctcccccggacgtcgtccaaggacgaacgtaggaagtacaagacgaactagtcggcgtgcgaccaactactgttccttctactcttacccgtccc

SEQ ID NO: 566323 - DNA, 515 bp, Homo sapiens; identical to SEQ ID NO: 551612
  misc_feature: HIJSMM301DB7RR.3.87.H10.1.454.light.4.raw

SEQ ID NO: 566324 - DNA, 510 bp, Homo sapiens
  misc_feature: HIJSMM301DWFW1.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgtccccccg

SEQ ID NO: 566325 - DNA, 487 bp, Homo sapiens; identical to SEQ ID NO: 536272
  misc_feature: HIJSMM301ED81Z.17.25.C03.1.454.light.4.raw

SEQ ID NO: 566326 - DNA, 494 bp, Homo sapiens
  misc_feature: HIJSMM301BQA40.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaactgtgg

SEQ ID NO: 566327 - DNA, 492 bp, Homo sapiens
  misc_feature: HIJSMM301CR35Q.51.38.D05.1.454.light.4.raw
cgatcgtatacacgaccggtgctcgatttagtatctgatagttgggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaaggctgaccgtcctcggtcagcccaaggctgccccctcggtcact

SEQ ID NO: 566328 - DNA, 510 bp, Homo sapiens
  misc_feature: HIJSMM301B7A3I.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccacctcct

SEQ ID NO: 566329 - DNA, 501 bp, Homo sapiens
  misc_feature: HIJSMM301CMFZW.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtctgggtcagcccaaggctgccccctggtca

SEQ ID NO: 566330 - DNA, 501 bp, Homo sapiens
  misc_feature: HIJSMM301ATT48.40.58.F03.1.454.light.4.raw
tctagcgactcacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcgccggggaccgaacgtggaaatcaaacgaactagtggctgcaccat

SEQ ID NO: 566331 - DNA, 486 bp, Homo sapiens; identical to SEQ ID NO: 537617
  misc_feature: HIJSMM301AJFQM.10.53.E09.1.454.light.4.raw

SEQ ID NO: 566332 - DNA, 488 bp, Homo sapiens; identical to SEQ ID NO: 539021
  misc_feature: HIJSMM301AX38E.21.4.A04.1.454.light.4.raw

SEQ ID NO: 566333 - DNA, 454 bp, Homo sapiens; identical to SEQ ID NO: 534964
  misc_feature: HIJSMM301C4CVG.19.86.H09.1.454.light.4.raw

SEQ ID NO: 566334 - DNA, 491 bp, Homo sapiens; identical to SEQ ID NO: 553956
  misc_feature: HIJSMM301DF6A5.4.22.B11.1.454.light.4.raw

SEQ ID NO: 566335 - DNA, 513 bp, Homo sapiens; identical to SEQ ID NO: 539678
  misc_feature: HIJSMM301BTOD6.17.37.D04.1.454.light.4.raw

SEQ ID NO: 566336 - DNA, 502 bp, Homo sapiens
  misc_feature: HIJSMM301C7KP8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggaccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 566337 - DNA, 519 bp, Homo sapiens
  misc_feature: HIJSMM301ARZS2.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatccttccccg

SEQ ID NO: 566338 - DNA, 503 bp, Homo sapiens
  misc_feature: HIJSMM301CT8Y0.21.22.B11.1.454.light.4.raw
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggngttcggcggagggaccaaactgaccgtcctaggtcaggcccaa

SEQ ID NO: 566339 - DNA, 444 bp, Homo sapiens; identical to SEQ ID NO: 535594
  misc_feature: HIJSMM301CVSU1.9.9.A09.1.454.light.4.raw

SEQ ID NO: 566340 - DNA, 509 bp, Homo sapiens; identical to SEQ ID NO: 541829
  misc_feature: HIJSMM301CH8X0.17.28.C06.1.454.light.4.raw

SEQ ID NO: 566341 - DNA, 492 bp, Homo sapiens
  misc_feature: HIJSMM301CIH4T.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatctggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcacc

SEQ ID NO: 566342 - DNA, 497 bp, Homo sapiens; identical to SEQ ID NO: 536371
  misc_feature: HIJSMM301BGUMG.16.78.H01.1.454.light.4.raw

SEQ ID NO: 566343 - DNA, 501 bp, Homo sapiens
  misc_feature: HIJSMM301EJWFR.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactagtggctgcaccatctgtcttcat

SEQ ID NO: 566344 - DNA, 460 bp, Homo sapiens; identical to SEQ ID NO: 539553
  misc_feature: HIJSMM301B0BYD.11.86.H09.1.454.light.4.raw

SEQ ID NO: 566345 - DNA, 499 bp, Homo sapiens
  misc_feature: HIJSMM301DQHC0.10.12.B01.1.454.light.4.raw
catagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcggagggtccaagctgaccgtcctaggtcagcccaa

SEQ ID NO: 566346 - DNA, 491 bp, Homo sapiens
  misc_feature: HIJSMM301BAWKW.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaactgtggctgcaccatctgt

SEQ ID NO: 566347 - DNA, 521 bp, Homo sapiens; identical to SEQ ID NO: 538715
  misc_feature: HIJSMM301C9HZ9.27.23.C01.1.454.light.4.raw

SEQ ID NO: 566348 - DNA, 454 bp, Homo sapiens; identical to SEQ ID NO: 534964
  misc_feature: HIJSMM301BBMRX.19.86.H09.1.454.light.4.raw

SEQ ID NO: 566349 - DNA, 456 bp, Homo sapiens; identical to SEQ ID NO: 546442
  misc_feature: HIJSMM301A6JC2.13.23.C01.1.454.light.4.raw

SEQ ID NO: 566350 - DNA, 517 bp, Homo sapiens; identical to SEQ ID NO: 546084
  misc_feature: HIJSMM301BPRWG.47.53.E09.1.454.light.4.raw

SEQ ID NO: 566351 - DNA, 501 bp, Homo sapiens; identical to SEQ ID NO: 540528
  misc_feature: HIJSMM301BM7LI.11.31.C09.1.454.light.4.raw

SEQ ID NO: 566352 - DNA, 515 bp, Homo sapiens
  misc_feature: HIJSMM301CAGM8.49.71.G05.1.454.light.4.raw
agtcgagagacacgaccggtgctcgatttagtgtcgtcgcaagagagagggggggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccctcctctct

SEQ ID NO: 566353 - DNA, 491 bp, Homo sapiens
  misc_feature: HIJSMM301DZL00.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 566354 - DNA, 385 bp, Homo sapiens; identical to SEQ ID NO: 538634
  misc_feature: HIJSMM301EMJQP.12.41.D08.1.454.light.4.raw

SEQ ID NO: 566355 - DNA, 511 bp, Homo sapiens
  misc_feature: HIJSMM301AT0HI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtaggaaagtacaaacgaactagtggcgtgtcaccactctgtcttctatcttccccg

SEQ ID NO: 566356 - DNA, 471 bp, Homo sapiens
  misc_feature: HIJSMM301C169M.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgatgccacttttggcgggggaccgaaggtggacatcaaacgaat

SEQ ID NO: 566357 - DNA, 500 bp, Homo sapiens
  misc_feature: HIJSMM301B1Z13.52.25.C03.1.454.light.4.raw
cgcagtacgacacgaccggtgctcgatttagtagtgtagatttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggctaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 566358 - DNA, 486 bp, Homo sapiens
  misc_feature: HIJSMM301AH3SV.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctccctcgctacgtaga

SEQ ID NO: 566359 - DNA, 488 bp, Homo sapiens
  misc_feature: HIJSMM301ATT1F.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctctactttcggcggagggaccaaggtggagatcaaacgaactgtggctgcaccatctgtt

SEQ ID NO: 566360 - DNA, 500 bp, Homo sapiens
  misc_feature: HIJSMM301BRN1X.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttccg

SEQ ID NO: 566361 - DNA, 508 bp, Homo sapiens; identical to SEQ ID NO: 546914
  misc_feature: HIJSMM301DXUUQ.17.41.D08.1.454.light.4.raw

SEQ ID NO: 566362 - DNA, 501 bp, Homo sapiens
  misc_feature: HIJSMM301BV3A0.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaacccactgtcta

SEQ ID NO: 566363 - DNA, 482 bp, Homo sapiens; identical to SEQ ID NO: 536622
  misc_feature: HIJSMM301C7O1Z.7.85.H08.1.454.light.4.raw

SEQ ID NO: 566364 - DNA, 503 bp, Homo sapiens; identical to SEQ ID NO: 538973
  misc_feature: HIJSMM301ASCH8.5.86.H09.1.454.light.4.raw

SEQ ID NO: 566365 - DNA, 521 bp, Homo sapiens; identical to SEQ ID NO: 539470
  misc_feature: HIJSMM301B461Z.27.23.C01.1.454.light.4.raw

SEQ ID NO: 566366 - DNA, 474 bp, Homo sapiens; identical to SEQ ID NO: 535264
  misc_feature: HIJSMM301CXDNM.13.76.G10.1.454.light.4.raw

SEQ ID NO: 566367 - DNA, 486 bp, Homo sapiens; identical to SEQ ID NO: 536553
  misc_feature: HIJSMM301CQ6UR.17.34.D01.1.454.light.4.raw

SEQ ID NO: 566368 - DNA, 487 bp, Homo sapiens; identical to SEQ ID NO: 537079
  misc_feature: HIJSMM301BC741.14.55.E11.1.454.light.4.raw

SEQ ID NO: 566369 - DNA, 512 bp, Homo sapiens; identical to SEQ ID NO: 535484
  misc_feature: HIJSMM301AOS3U.8.23.C01.1.454.light.4.raw

SEQ ID NO: 566370 - DNA, 496 bp, Homo sapiens; identical to SEQ ID NO: 535109
  misc_feature: HIJSMM301BU6HS.16.78.H01.1.454.light.4.raw

SEQ ID NO: 566371 - DNA, 486 bp, Homo sapiens
  misc_feature: HIJSMM301CKZRY.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaattattttagtgctccgtacacttttggccaggggaccaagttggagatcaaacgaa

SEQ ID NO: 566372 - DNA, 456 bp, Homo sapiens
  misc_feature: HIJSMM301E0VH9.49.15.B04.1.454.light.4.raw
agtcgagagacacgaccggtgctcgatttagacagtatatatccgcgggcacgaccggtgctcgatttagacagtatatatccgcgggcacgaccggtgctcgatttagctacgactgcaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 566373 - DNA, 502 bp, Homo sapiens
  misc_feature: HIJSMM301BN94P.21.38.D05.1.454.light.4.raw
tcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcattcc

SEQ ID NO: 566374 - DNA, 501 bp, Homo sapiens
  misc_feature: HIJSMM301DGZX6.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgcagttggttcctcttttcaagatattcggcggagggaccaggctgaccgtcctgagtcagcccaaggctg

SEQ ID NO: 566375 - DNA, 479 bp, Homo sapiens; identical to SEQ ID NO: 535118
  misc_feature: HIJSMM301AXVRU.13.59.F04.1.454.light.4.raw

SEQ ID NO: 566376 - DNA, 490 bp, Homo sapiens; identical to SEQ ID NO: 551621
  misc_feature: HIJSMM301D1K7H.14.36.D03.1.454.light.4.raw

SEQ ID NO: 566377 - DNA, 504 bp, Homo sapiens
  misc_feature: HIJSMM301DIABN.18.11.A11.1.454.light.4.raw
  modified_base (403)..(403): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggagtccggggtccctgaccgattcagaggcagcgggtctgggacagatttcactctcaccatcaccaacctgcaggctgaagatgnggcagtttattactgtcagcaatactatagtcctcctctcacgttcggcggagggaccaagggtggagatacaaacgaactgtggctgcaccatctgtctt

SEQ ID NO: 566378 - DNA, 503 bp, Homo sapiens; identical to SEQ ID NO: 536834
  misc_feature: HIJSMM301EHP8F.2.35.D02.1.454.light.4.raw

SEQ ID NO: 566379 - DNA, 506 bp, Homo sapiens; identical to SEQ ID NO: 543993
  misc_feature: HIJSMM301DU6R5.18.78.H01.1.454.light.4.raw

SEQ ID NO: 566380 - DNA, 478 bp, Homo sapiens
  misc_feature: HIJSMM301AELOC.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaac

SEQ ID NO: 566381 - DNA, 508 bp, Homo sapiens
  misc_feature: HIJSMM301ECDLM.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaaggctgaggacgaggctgattattactgcagctcatatacaagcagcagcactcaagtcttcggaaactgggaccaaaggtcaccgtcctaggtcagcccaaggcccaaccccta

SEQ ID NO: 566382 - DNA, 383 bp, Homo sapiens
  misc_feature: HIJSMM301CAVKD.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacca

SEQ ID NO: 566383 - DNA, 519 bp, Homo sapiens
  misc_feature: HIJSMM301B5S8H.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcggactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcctacg

SEQ ID NO: 566384 - DNA, 498 bp, Homo sapiens; identical to SEQ ID NO: 537020
  misc_feature: HIJSMM301D2AR5.26.26.C04.1.454.light.4.raw

SEQ ID NO: 566385 - DNA, 504 bp, Homo sapiens; identical to SEQ ID NO: 544267
  misc_feature: HIJSMM301EC7SE.19.85.H08.1.454.light.4.raw

SEQ ID NO: 566386 - DNA, 485 bp, Homo sapiens; identical to SEQ ID NO: 536040
  misc_feature: HIJSMM301B52M6.15.1.A01.1.454.light.4.raw

SEQ ID NO: 566387 - DNA, 479 bp, Homo sapiens
  misc_feature: HIJSMM301DGPOF.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgacccg

SEQ ID NO: 566388 - DNA, 488 bp, Homo sapiens; identical to SEQ ID NO: 535861
  misc_feature: HIJSMM301ET42B.14.55.E11.1.454.light.4.raw

SEQ ID NO: 566389 - DNA, 494 bp, Homo sapiens
  misc_feature: HIJSMM301BZCHT.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 566390 - DNA, 502 bp, Homo sapiens
  misc_feature: HIJSMM301CV17V.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgaactgtggctgcaccatctgtcttcatcttcccgccatctgacctaa

SEQ ID NO: 566391 - DNA, 479 bp, Homo sapiens; identical to SEQ ID NO: 535188
  misc_feature: HIJSMM301BH0Z9.10.74.G08.1.454.light.4.raw

SEQ ID NO: 566392 - DNA, 505 bp, Homo sapiens; identical to SEQ ID NO: 535987
  misc_feature: HIJSMM301BBGID.18.37.D04.1.454.light.4.raw

SEQ ID NO: 566393 - DNA, 471 bp, Homo sapiens
  misc_feature: HIJSMM301DO1UT.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctagagatttgcaacttacttttgtcaacaggctcagagtttcccgctcactttcggcggagggaccaaggtggagatcaaacgaa

SEQ ID NO: 566394 - DNA, 501 bp, Homo sapiens; identical to SEQ ID NO: 540528
  misc_feature: HIJSMM301AJSZQ.11.31.C09.1.454.light.4.raw

SEQ ID NO: 566395 - DNA, 489 bp, Homo sapiens; identical to SEQ ID NO: 535139
  misc_feature: HIJSMM301AJG2Y.14.55.E11.1.454.light.4.raw

SEQ ID NO: 566396 - DNA, 484 bp, Homo sapiens
  misc_feature: HIJSMM301EUYQL.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactggacccacgttaccgtcctaggtcagccc

SEQ ID NO: 566397 - DNA, 498 bp, Homo sapiens
  misc_feature: HIJSMM301ERNYR.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctaccatccgcgggacccaggctgtggatgaggctgactattactgtcaggcgtgggacagggaggctgcgattttcggcggagggaccagtctgaccgtcctaggtcagccaaggctgccccctcggtcactctgtt

SEQ ID NO: 566398 - DNA, 467 bp, Homo sapiens; identical to SEQ ID NO: 535997
  misc_feature: HIJSMM301EUFMY.5.36.D03.1.454.light.4.raw

SEQ ID NO: 566399 - DNA, 486 bp, Homo sapiens
  misc_feature: HIJSMM301CFCWK.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggtccaggggaccaacctggagat

SEQ ID NO: 566400 - DNA, 488 bp, Homo sapiens
  misc_feature: HIJSMM301D0TDY.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtcctaggtcagcccaaggccaacccca

SEQ ID NO: 566401 - DNA, 509 bp, Homo sapiens; identical to SEQ ID NO: 541168
  misc_feature: HIJSMM301AGGC6.5.60.F05.1.454.light.4.raw

SEQ ID NO: 566402 - DNA, 485 bp, Homo sapiens; identical to SEQ ID NO: 535606
  misc_feature: HIJSMM301EZX5Z.47.46.E02.1.454.light.4.raw

SEQ ID NO: 566403 - DNA, 495 bp, Homo sapiens
  misc_feature: HIJSMM301A1LQQ.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttttactgtcagcagtatagtaactggcctccgtactactttggccaggggaccaagctagaaatacaaacgaactgtggctgcaccatctgtcttcta

SEQ ID NO: 566404 - DNA, 514 bp, Homo sapiens
  misc_feature: HIJSMM301AN4Q0.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccagggaccgaccagtagaaatagagacgaaacgtacgtggcgtgcaccactctgttcttctactcttcccgt

SEQ ID NO: 566405 - DNA, 500 bp, Homo sapiens
  misc_feature: HIJSMM301B2LQU.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccaaggtggaaatacaaacgaactgtggctgcacc

SEQ ID NO: 566406 - DNA, 507 bp, Homo sapiens; identical to SEQ ID NO: 557429
  misc_feature: HIJSMM301D7SJ7.15.59.F04.1.454.light.4.raw

SEQ ID NO: 566407 - DNA, 488 bp, Homo sapiens; identical to SEQ ID NO: 542699
  misc_feature: HIJSMM301A2EP6.12.51.E07.1.454.light.4.raw

SEQ ID NO: 566408 - DNA, 485 bp, Homo sapiens; identical to SEQ ID NO: 536040
  misc_feature: HIJSMM301CT2EA.15.1.A01.1.454.light.4.raw

SEQ ID NO: 566409 - DNA, 480 bp, Homo sapiens; identical to SEQ ID NO: 557916
  misc_feature: HIJSMM301A91MV.51.76.G10.1.454.light.4.raw

SEQ ID NO: 566410 - DNA, 476 bp, Homo sapiens; identical to SEQ ID NO: 538611
  misc_feature: HIJSMM301BOWFI.7.81.H04.1.454.light.4.raw

SEQ ID NO: 566411 - DNA, 501 bp, Homo sapiens; identical to SEQ ID NO: 535746
  misc_feature: HIJSMM301AX4NW.18.11.A11.1.454.light.4.raw

SEQ ID NO: 566412 - DNA, 497 bp, Homo sapiens
  misc_feature: HIJSMM301AVLKH.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgagctcactttcggcggaggaccgaaggtggagatacaaacgaactgt

SEQ ID NO: 566413 - DNA, 466 bp, Homo sapiens; identical to SEQ ID NO: 535366
  misc_feature: HIJSMM301AYCJH.13.4.A04.1.454.light.4.raw

SEQ ID NO: 566414 - DNA, 512 bp, Homo sapiens
  misc_feature: HIJSMM301BFXK6.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagcgtgacgtcaagggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctggtcactctcg

SEQ ID NO: 566415 - DNA, 504 bp, Homo sapiens; identical to SEQ ID NO: 555616
  misc_feature: HIJSMM301EQ78A.5.86.H09.1.454.light.4.raw

SEQ ID NO: 566416 - DNA, 505 bp, Homo sapiens
  misc_feature: HIJSMM301D7P1J.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtca

SEQ ID NO: 566417 - DNA, 480 bp, Homo sapiens
  misc_feature: HIJSMM301D0UXD.22.59.F04.1.454.light.4.raw
  modified_base (205)..(205): a, c, t, g, unknown or other
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagtattttgctagtttattactgtcagcactataataactggcctccgtacagtttggcctagggaccaagctggagatcaacgaa

SEQ ID NO: 566418 - DNA, 494 bp, Homo sapiens; identical to SEQ ID NO: 536810
  misc_feature: HIJSMM301BI0NL.10.79.H02.1.454.light.4.raw

SEQ ID NO: 566419 - DNA, 486 bp, Homo sapiens; identical to SEQ ID NO: 535458
  misc_feature: HIJSMM301B6SM0.7.75.G09.1.454.light.4.raw

SEQ ID NO: 566420 - DNA, 509 bp, Homo sapiens
  misc_feature: HIJSMM301CK347.4.10.A10.1.454.light.4.raw
  modified_base (421)..(421): a, c, t, g, unknown or other
agcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacntcctacgtggtgcggtgttcggcggagggaccaaggttgaccgtcctgggtcagcccaaggctgccccctcggtcactctgttcccta

SEQ ID NO: 566421 - DNA, 484 bp, Homo sapiens
  misc_feature: HIJSMM301A8ZQX.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaacgaactgtggctgca

SEQ ID NO: 566422 - DNA, 501 bp, Homo sapiens; identical to SEQ ID NO: 540528
  misc_feature: HIJSMM301D13CE.11.31.C09.1.454.light.4.raw

SEQ ID NO: 566423 - DNA, 493 bp, Homo sapiens; identical to SEQ ID NO: 535745
  misc_feature: HIJSMM301DU14X.47.78.H01.1.454.light.4.raw

SEQ ID NO: 566424 - DNA, 494 bp, Homo sapiens; identical to SEQ ID NO: 534994
  misc_feature: HIJSMM301DSSPM.27.78.H01.1.454.light.4.raw

SEQ ID NO: 566425 - DNA, 494 bp, Homo sapiens; identical to SEQ ID NO: 549057
  misc_feature: HIJSMM301C4BTE.10.33.C11.1.454.light.4.raw

SEQ ID NO: 566426 - DNA, 488 bp, Homo sapiens; identical to SEQ ID NO: 535990
  misc_feature: HIJSMM301CZKZD.11.28.C06.1.454.light.4.raw

SEQ ID NO: 566427 - DNA, 519 bp, Homo sapiens
  misc_feature: HIJSMM301B6M3U.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggcactctgttcccaccct

SEQ ID NO: 566428 - DNA, 506 bp, Homo sapiens; identical to SEQ ID NO: 557483
  misc_feature: HIJSMM301BI7X1.22.21.B10.1.454.light.4.raw

SEQ ID NO: 566429 - DNA, 507 bp, Homo sapiens
  misc_feature: HIJSMM301DSV6S.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagcgaactagtggctgcaccactctgtcttcactcttcccgt

SEQ ID NO: 566430 - DNA, 485 bp, Homo sapiens; identical to SEQ ID NO: 536040
  misc_feature: HIJSMM301AYKVE.15.1.A01.1.454.light.4.raw

SEQ ID NO: 566431 - DNA, 484 bp, Homo sapiens
  misc_feature: HIJSMM301ATN03.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgagatgttgggctctattattgcatgcaagctctacaagtcccgctcactttcggcggagggaccaaggtggagatcaaacgaa

SEQ ID NO: 566432 - DNA, 499 bp, Homo sapiens
  misc_feature: HIJSMM301D9O6Y.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtaa

SEQ ID NO: 566433 - DNA, 488 bp, Homo sapiens; identical to SEQ ID NO: 543855
  misc_feature: HIJSMM301D0E71.19.71.G05.1.454.light.4.raw

SEQ ID NO: 566434 - DNA, 513 bp, Homo sapiens
  misc_feature: HIJSMM301DIRQ3.48.66.F11.1.454.light.4.raw
agtatacatacacgaccggtgctcgatttagtcacgcgagaaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgtcccta

SEQ ID NO: 566435 - DNA, 475 bp, Homo sapiens
  misc_feature: HIJSMM301CMCJJ.4.76.G10.1.454.light.4.raw
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccgaagggaccaaggtggaaatcaaacgaactagtggctgcacc

SEQ ID NO: 566436 - DNA, 489 bp, Homo sapiens
  misc_feature: HIJSMM301BMQ4Q.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatggttggggtttattactgcatgcaagctctacaaactccttacacttttggccaggggaccaagctggagatcaaacgaa

SEQ ID NO: 566437 - DNA, 488 bp, Homo sapiens
  misc_feature: HIJSMM301AS8AK.41.57.F02.1.454.light.4.raw
tctatactatcacgaccggtgctcgatttagctcgatataggttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 566438 - DNA, 486 bp, Homo sapiens; identical to SEQ ID NO: 536555
  misc_feature: HIJSMM301BIJO2.26.23.C01.1.454.light.4.raw

SEQ ID NO: 566439 - DNA, 510 bp, Homo sapiens
  misc_feature: HIJSMM301AZJPQ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgtcgtccacgggaccgacacgtagaaatagagacgaacgtagtggcgtgcaccatctgtcttctactcttcccgt

SEQ ID NO: 566440 - DNA, 503 bp, Homo sapiens
  misc_feature: HIJSMM301BT5LL.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctcttgctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 566441 - DNA, 500 bp, Homo sapiens; identical to SEQ ID NO: 539795
  misc_feature: HIJSMM301DQDTZ.22.38.D05.1.454.light.4.raw

SEQ ID NO: 566442 - DNA, 470 bp, Homo sapiens; identical to SEQ ID NO: 536130
  misc_feature: HIJSMM301BFE9Z.7.81.H04.1.454.light.4.raw

SEQ ID NO: 566443 - DNA, 466 bp, Homo sapiens
  misc_feature: HIJSMM301CSYDE.17.28.C06.1.454.light.4.raw
cgtagactagcacgaccggtgctcgatttagagctcacgtattgggtttggggggtgtggtggtctccactcccgcccagtctgtgctgactcagccaccctcagtgtctggggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttccccaccctcctcctagtctacg

SEQ ID NO: 566444 - DNA, 507 bp, Homo sapiens
  misc_feature: HIJSMM301EMI54.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtaggaaatacaaacgaactagtggctgcaccactctgtcttcatcttccccg

SEQ ID NO: 566445 - DNA, 499 bp, Homo sapiens
  misc_feature: HIJSMM301EFNNZ.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccatct

SEQ ID NO: 566446 - DNA, 506 bp, Homo sapiens
  misc_feature: HIJSMM301BRPF1.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtcta

SEQ ID NO: 566447 - DNA, 497 bp, Homo sapiens; identical to SEQ ID NO: 538030
  misc_feature: HIJSMM301B3MRC.40.23.C01.1.454.light.4.raw

SEQ ID NO: 566448 - DNA, 501 bp, Homo sapiens; identical to SEQ ID NO: 543562
  misc_feature: HIJSMM301CGSZS.10.71.G05.1.454.light.4.raw

SEQ ID NO: 566449 - DNA, 485 bp, Homo sapiens; identical to SEQ ID NO: 535822
  misc_feature: HIJSMM301DYOPM.14.53.E09.1.454.light.4.raw

SEQ ID NO: 566450 - DNA, 504 bp, Homo sapiens
  misc_feature: HIJSMM301C91IM.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggcctgccccctcggt

SEQ ID NO: 566451 - DNA, 485 bp, Homo sapiens; identical to SEQ ID NO: 535501
  misc_feature: HIJSMM301DIJCI.3.10.A10.1.454.light.4.raw

SEQ ID NO: 566452 - DNA, 497 bp, Homo sapiens
  misc_feature: HIJSMM301BJB2H.14.35.D02.1.454.light.4.raw
cgtctagtaccacgaccggtgctcgatttagcacacgatagttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatatatagtactccctacacttttggccaggggaccaagctggagatcaaacgaactgtggctgcacc

SEQ ID NO: 566453 - DNA, 520 bp, Homo sapiens
  misc_feature: HIJSMM301CZ697.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtcgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggctattttcggtgttcggcgggagggacccgaggtgaccgtcctacgtcagcccaaggtccg

SEQ ID NO: 566454 - DNA, 521 bp, Homo sapiens; identical to SEQ ID NO: 538715
  misc_feature: HIJSMM301ANLFB.27.23.C01.1.454.light.4.raw

SEQ ID NO: 566455 - DNA, 499 bp, Homo sapiens
  misc_feature: HIJSMM301DGL8K.5.24.C02.1.454.light.4.raw
  modified_base (248)..(248): a, c, t, g, unknown or other
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaagcccccaaactcatcatttttgaggtcactacgcgaccctcaggggtccctgatcgcttctctggctccaagtctggcaacacggcctcctgaccgtctctgggctccaggctgaggatgaggctgattattactgcagctcatatgcaggcagcagcagtccccatgtgatcttcggcggggggaccaagctgaccgtcctaggtccagcccaaggctg

SEQ ID NO: 566456 - DNA, 496 bp, Homo sapiens; identical to SEQ ID NO: 535109
  misc_feature: HIJSMM301D1BLN.16.78.H01.1.454.light.4.raw

SEQ ID NO: 566457 - DNA, 444 bp, Homo sapiens; identical to SEQ ID NO: 534993
  misc_feature: HIJSMM301BL2AX.5.9.A09.1.454.light.4.raw

SEQ ID NO: 566458 - DNA, 530 bp, Homo sapiens
  misc_feature: HIJSMM301CO6W6.52.61.F06.1.454.light.4.raw
cgcagtacgacacgaccggtgctcgatttagctacgctctaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccgccctcctctac

SEQ ID NO: 566459 - DNA, 490 bp, Homo sapiens; identical to SEQ ID NO: 560912
  misc_feature: HIJSMM301DYVI0.41.25.C03.1.454.light.4.raw

SEQ ID NO: 566460 - DNA, 493 bp, Homo sapiens; identical to SEQ ID NO: 536246
  misc_feature: HIJSMM301AYMIK.49.66.F11.1.454.light.4.raw

SEQ ID NO: 566461 - DNA, 466 bp, Homo sapiens; identical to SEQ ID NO: 535366
  misc_feature: HIJSMM301D9DE8.13.4.A04.1.454.light.4.raw

SEQ ID NO: 566462 - DNA, 493 bp, Homo sapiens; identical to SEQ ID NO: 535084
  misc_feature: HIJSMM301EEW39.47.64.F09.1.454.light.4.raw

SEQ ID NO: 566463 - DNA, 460 bp, Homo sapiens; identical to SEQ ID NO: 545790
  misc_feature: HIJSMM301AXBDG.22.28.C06.1.454.light.4.raw
  modified_base (442)..(442): a, c, t, g, unknown or other

SEQ ID NO: 566464 - DNA, 497 bp, Homo sapiens
  misc_feature: HIJSMM301E0XCR.11.60.F05.1.454.light.4.raw
cgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccaagggaccaaggtggaaatcaaacgaactgtggctgcaccatctgtctt

SEQ ID NO: 566465 - DNA, 480 bp, Homo sapiens
  misc_feature: HIJSMM301BW733.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtgttttggctgttcggcggcgggacc

SEQ ID NO: 566466 - DNA, 472 bp, Homo sapiens; identical to SEQ ID NO: 535898
  misc_feature: HIJSMM301C43BF.15.8.A08.1.454.light.4.raw

SEQ ID NO: 566467 - DNA, 488 bp, Homo sapiens; identical to SEQ ID NO: 536742
  misc_feature: HIJSMM301BZG8E.3.72.G06.1.454.light.4.raw

SEQ ID NO: 566468 - DNA, 486 bp, Homo sapiens; identical to SEQ ID NO: 537617
  misc_feature: HIJSMM301CMWJ1.10.53.E09.1.454.light.4.raw

SEQ ID NO: 566469 - DNA, 418 bp, Homo sapiens
  misc_feature: HIJSMM301BXMJA.10.86.H09.1.454.light.4.raw
catagtagtgcacgaccggtgctcgatttagtgctatagacttggggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggtcgattattactgcgcaacttgggactccaacctgactgttggggctttcggcggagggactaagttgaccgtcctacgtcagcccaaggctgccccctcggtcactctgttcccaccctcctccactactatg

SEQ ID NO: 566470 - DNA, 449 bp, Homo sapiens
  misc_feature: HIJSMM301BLK89.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtcctaagtcagcccaaggccaacccctctgtcactctcgttcccgccctcctccatactcgta

SEQ ID NO: 566471 - DNA, 495 bp, Homo sapiens
  misc_feature: HIJSMM301EH5J8.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataacgcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcct

SEQ ID NO: 566472 - DNA, 500 bp, Homo sapiens
  misc_feature: HIJSMM301BYJKV.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggccaagctgaccgtcctgcgtcagcccaaggctgccccctcggtcact

SEQ ID NO: 566473 - DNA, 502 bp, Homo sapiens; identical to SEQ ID NO: 549179
  misc_feature: HIJSMM301BOSHR.14.57.F02.1.454.light.4.raw

SEQ ID NO: 566474 - DNA, 486 bp, Homo sapiens
  misc_feature: HIJSMM301CJDEL.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccgacggtggaaatacaaacgaactagtggctgcaccatctgtctt

SEQ ID NO: 566475 - DNA, 474 bp, Homo sapiens; identical to SEQ ID NO: 538184
  misc_feature: HIJSMM301BE7C3.13.76.G10.1.454.light.4.raw

SEQ ID NO: 566476 - DNA, 460 bp, Homo sapiens; identical to SEQ ID NO: 536053
  misc_feature: HIJSMM301CJFC7.22.28.C06.1.454.light.4.raw

SEQ ID NO: 566477 - DNA, 489 bp, Homo sapiens; identical to SEQ ID NO: 535386
  misc_feature: HIJSMM301C3NOZ.12.51.E07.1.454.light.4.raw

SEQ ID NO: 566478 - DNA, 416 bp, Homo sapiens
  misc_feature: HIJSMM301A1SXZ.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 566479 - DNA, 503 bp, Homo sapiens; identical to SEQ ID NO: 558647
  misc_feature: HIJSMM301CQV2Q.8.28.C06.1.454.light.4.raw

SEQ ID NO: 566480 - DNA, 488 bp, Homo sapiens; identical to SEQ ID NO: 555249
  misc_feature: HIJSMM301AGXBU.17.34.D01.1.454.light.4.raw

SEQ ID NO: 566481 - DNA, 414 bp, Homo sapiens; identical to SEQ ID NO: 563153
  misc_feature: HIJSMM301CDWZS.48.39.D06.1.454.light.4.raw

SEQ ID NO: 566482 - DNA, 485 bp, Homo sapiens; identical to SEQ ID NO: 542735
  misc_feature: HIJSMM301AHJPP.26.45.E01.1.454.light.4.raw

SEQ ID NO: 566483 - DNA, 505 bp, Homo sapiens; identical to SEQ ID NO: 538422
  misc_feature: HIJSMM301A9J3B.19.78.H01.1.454.light.4.raw

SEQ ID NO: 566484 - DNA, 445 bp, Homo sapiens
  misc_feature: HIJSMM301AW2WV.2.76.G10.1.454.light.4.raw
acgctcgacacacgaccggtgctcgatttagtcactcatacagggtcctgggcccagtctgtgctgactcagccaccctcagcgtctgggcccccgggcgagagggtctaccgatcctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgtggatgaggctgtttatttctgttcagcacgggatgccagccggaatggcaattgggtattcggcggagggaccaagttgaccgtcctaagtcagcccaaggctgccccctggtcactctgttcccaccctctctgtcgagcgt

SEQ ID NO: 566485 - DNA, 446 bp, Homo sapiens
  misc_feature: HIJSMM301DGFMP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttataatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 566486 - DNA, 383 bp, Homo sapiens; identical to SEQ ID NO: 447524
  misc_feature: HIJSMM301A0KT8.41.26.C04.1.454.light.4.raw

SEQ ID NO: 566487 - DNA, 518 bp, Homo sapiens; identical to SEQ ID NO: 539372
  misc_feature: HIJSMM301AUDJ0.7.86.H09.1.454.light.4.raw

SEQ ID NO: 566488 - DNA, 490 bp, Homo sapiens; identical to SEQ ID NO: 538273
  misc_feature: HIJSMM301DA4DV.16.73.G07.1.454.light.4.raw

SEQ ID NO: 566489 - DNA, 518 bp, Homo sapiens
  misc_feature: HIJSMM301A70K3.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtccactctgttcccaccctcctctac

SEQ ID NO: 566490 - DNA, 489 bp, Homo sapiens
  misc_feature: HIJSMM301DXFHN.46.26.C04.1.454.light.4.raw
actagcagtacacgaccggtgctcgatttagtctagcgactttgggtttggggtgatcaggactcctcagttcaccttctcacaatgaggctccctgctcagcccctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggaggatcaaacgaactgt

SEQ ID NO: 566491 - DNA, 506 bp, Homo sapiens; identical to SEQ ID NO: 539721
  misc_feature: HIJSMM301DVYVV.3.79.H02.1.454.light.4.raw

SEQ ID NO: 566492 - DNA, 502 bp, Homo sapiens
  misc_feature: HIJSMM301CX7H2.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacatattattctactccgccgacgtcggccggggacaacgtggaatcaacgaactgtggctgcaccatctgtcttcta

SEQ ID NO: 566493 - DNA, 492 bp, Homo sapiens
  misc_feature: HIJSMM301BIQBP.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctggagatcaaacgaactgtgg

SEQ ID NO: 566494 - DNA, 492 bp, Homo sapiens
  misc_feature: HIJSMM301EJ83Z.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaactgt

SEQ ID NO: 566495 - DNA, 441 bp, Homo sapiens; identical to SEQ ID NO: 534971
  misc_feature: HIJSMM301B9XVO.11.3.A03.1.454.light.4.raw

SEQ ID NO: 566496 - DNA, 479 bp, Homo sapiens; identical to SEQ ID NO: 553343
  misc_feature: HIJSMM301EUM6D.43.12.B01.1.454.light.4.raw

SEQ ID NO: 566497 - DNA, 498 bp, Homo sapiens
  misc_feature: HIJSMM301AZNDP.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactctcg

SEQ ID NO: 566498 - DNA, 480 bp, Homo sapiens; identical to SEQ ID NO: 542764
  misc_feature: HIJSMM301CILYY.48.26.C04.1.454.light.4.raw

SEQ ID NO: 566499 - DNA, 506 bp, Homo sapiens
  misc_feature: HIJSMM301E1ROK.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggaggccgaccagtcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaatcaaacgaactgtggctgcaccat

SEQ ID NO: 566500 - DNA, 486 bp, Homo sapiens; identical to SEQ ID NO: 535043
  misc_feature: HIJSMM301CP1BQ.46.35.D02.1.454.light.4.raw

SEQ ID NO: 566501 - DNA, 495 bp, Homo sapiens
  misc_feature: HIJSMM301C4I76.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaagatcagcagggtggaggctgaggatgttggggtttattactgcatgcaaggtacacactggcccgtcacccttcggccaagggacacgactggagattaaacgaactgtggctgca

SEQ ID NO: 566502 - DNA, 514 bp, Homo sapiens
  misc_feature: HIJSMM301C98EJ.43.59.F04.1.454.light.4.raw
  modified_base (363)..(363): a, c, t, g, unknown or other
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggttttcttatcgcttctctggctccaagtctggcaacncggcctcctgaccatctctgggctccaggctgaggacgaggctgattattactgcaactcacttacaacgaccgacacttgcgtattcggcggcgggaccaagctgaccgtcctaggtcagcccaaggctcgccccctcggtcactctgtt

SEQ ID NO: 566503 - DNA, 494 bp, Homo sapiens; identical to SEQ ID NO: 535828
  misc_feature: HIJSMM301D2YA7.3.36.D03.1.454.light.4.raw

SEQ ID NO: 566504 - DNA, 488 bp, Homo sapiens; identical to SEQ ID NO: 535081
  misc_feature: HIJSMM301D5WGP.26.23.C01.1.454.light.4.raw

SEQ ID NO: 566505 - DNA, 513 bp, Homo sapiens
  misc_feature: HIJSMM301BJAZL.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagtccaaggccaaccccactgtcactctgttcccaccct

SEQ ID NO: 566506 - DNA, 478 bp, Homo sapiens
  misc_feature: HIJSMM301DZPNV.21.25.C03.1.454.light.4.raw
  modified_base (445)..(445): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcactcagcctccctggtcatcgctgggctccaggctgacgatgaggctgattattattgccagtcctatgacaanaccctgcgtggttttggctgttcgcggcgggac

SEQ ID NO: 566507 - DNA, 505 bp, Homo sapiens; identical to SEQ ID NO: 549187
  misc_feature: HIJSMM301DTSI1.12.53.E09.1.454.light.4.raw

SEQ ID NO: 566508 - DNA, 354 bp, Homo sapiens; identical to SEQ ID NO: 535026
  misc_feature: HIJSMM301BBASU.19.22.B11.1.454.light.4.raw

SEQ ID NO: 566509 - DNA, 502 bp, Homo sapiens
  misc_feature: HIJSMM301DTOFU.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccg

SEQ ID NO: 566510 - DNA, 508 bp, Homo sapiens; identical to SEQ ID NO: 557405
  misc_feature: HIJSMM301DMDB7.8.33.C11.1.454.light.4.raw

SEQ ID NO: 566511 - DNA, 498 bp, Homo sapiens
  misc_feature: HIJSMM301EZDTP.18.78.H01.1.454.light.4.raw
  modified_base (320)..(320): a, c, t, g, unknown or other
tacgagtatgcacgaccggtgctcgatttagtgtgagtagtttgggtttgggggggtcgtcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctnaggggtttctaatcgcttctctggctccaagtctggcaacacggcctccctgaccatctctgggctccgaggctgaggacgaggctgattattactgcagctcatatacaagcagcagcactcaagtcttcggaactgggaccaaggtcaccgtctagtcagcccaaggccaacccac

SEQ ID NO: 566512 - DNA, 506 bp, Homo sapiens; identical to SEQ ID NO: 534969
  misc_feature: HIJSMM301DKH9K.18.37.D04.1.454.light.4.raw

SEQ ID NO: 566513 - DNA, 493 bp, Homo sapiens; identical to SEQ ID NO: 535770
  misc_feature: HIJSMM301B8RU8.51.71.G05.1.454.light.4.raw

SEQ ID NO: 566514 - DNA, 485 bp, Homo sapiens
  misc_feature: HIJSMM301EYTQH.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggcggagggaccgaaggtggagatacaaacgaa

SEQ ID NO: 566515 - DNA, 517 bp, Homo sapiens; identical to SEQ ID NO: 538938
  misc_feature: HIJSMM301BX04E.7.86.H09.1.454.light.4.raw

SEQ ID NO: 566516 - DNA, 525 bp, Homo sapiens
  misc_feature: HIJSMM301DRSHY.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcggggcaagctgccctgaccctaacgggggcgcagcctgaggacgaggccgactattattgcctactatcatttgatggtggtcgtctgcccattttcggcggcgggaccgagggtggccgtcctgggtcagcccaaggctgccccctcggtcactctgttcccaccctcctcctagtctacg

SEQ ID NO: 566517 - DNA, 499 bp, Homo sapiens
  misc_feature: HIJSMM301DAAQL.7.87.H10.1.454.light.4.raw
  modified_base (466)..(466): a, c, t, g, unknown or other
  modified_base (469)..(469): a, c, t, g, unknown or other
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggaccgtgtcagacgagaggagagaacaacgaacaggntgngcgacactactactctctctctcctcctct

SEQ ID NO: 566518 - DNA, 485 bp, Homo sapiens; identical to SEQ ID NO: 544818
  misc_feature: HIJSMM301BS54V.13.36.D03.1.454.light.4.raw

SEQ ID NO: 566519 - DNA, 466 bp, Homo sapiens; identical to SEQ ID NO: 535366
  misc_feature: HIJSMM301DL82Q.13.4.A04.1.454.light.4.raw

SEQ ID NO: 566520 - DNA, 494 bp, Homo sapiens
  misc_feature: HIJSMM301CP59C.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctcgaccatctctgggcgtccaggctgaggacgagggtggattattacttgcagctcatatagaagtggcagcactctcgtattcggcggtgggaccgaagctgaccgtcctaggtcacgcccaacggc

SEQ ID NO: 566521 - DNA, 454 bp, Homo sapiens; identical to SEQ ID NO: 534964
  misc_feature: HIJSMM301EP23I.19.86.H09.1.454.light.4.raw

SEQ ID NO: 566522 - DNA, 489 bp, Homo sapiens; identical to SEQ ID NO: 536013
  misc_feature: HIJSMM301D0BSX.26.23.C01.1.454.light.4.raw

SEQ ID NO: 566523 - DNA, 488 bp, Homo sapiens
  misc_feature: HIJSMM301BBM8Q.48.1.A01.1.454.light.4.raw
agtatacatacacgaccggtgctcgatttagacgtctcatcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccgagggtaggaaatacaaacgaaactagtggctgcaccatctgtctt

SEQ ID NO: 566524 - DNA, 493 bp, Homo sapiens
  misc_feature: HIJSMM301BVF4H.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcact

SEQ ID NO: 566525 - DNA, 467 bp, Homo sapiens
  misc_feature: HIJSMM301B391D.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagaattaaacgaa

SEQ ID NO: 566526 - DNA, 489 bp, Homo sapiens; identical to SEQ ID NO: 535139
  misc_feature: HIJSMM301BB3FS.14.55.E11.1.454.light.4.raw

SEQ ID NO: 566527 - DNA, 496 bp, Homo sapiens; identical to SEQ ID NO: 551939
  misc_feature: HIJSMM301A9STL.19.71.G05.1.454.light.4.raw

SEQ ID NO: 566528 - DNA, 482 bp, Homo sapiens; identical to SEQ ID NO: 550464
  misc_feature: HIJSMM301BBP8F.13.50.E06.1.454.light.4.raw

SEQ ID NO: 566529 - DNA, 487 bp, Homo sapiens
  misc_feature: HIJSMM301CE3GX.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccccctctctacgttcgggcggggaccgaggtggagatacaaacgaactgtgtctcgcaccta

SEQ ID NO: 566530 - DNA, 501 bp, Homo sapiens; identical to SEQ ID NO: 548645
  misc_feature: HIJSMM301ARL7E.14.23.C01.1.454.light.4.raw

SEQ ID NO: 566531 - DNA, 477 bp, Homo sapiens
  misc_feature: HIJSMM301A7TZA.48.42.D09.1.454.light.4.raw
agtatacatacacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtcacctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattattctgctgctcatatgcagccaactattatgtcttcggaactgagaccaaggtcaccgtcctac

SEQ ID NO: 566532 - DNA, 480 bp, Homo sapiens
  misc_feature: HIJSMM301CBM16.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgacgtcctaggtcacg

SEQ ID NO: 566533 - DNA, 484 bp, Homo sapiens; identical to SEQ ID NO: 547458
  misc_feature: HIJSMM301COV8Y.15.1.A01.1.454.light.4.raw

SEQ ID NO: 566534 - DNA, 505 bp, Homo sapiens; identical to SEQ ID NO: 551816
  misc_feature: HIJSMM301B6BYB.18.78.H01.1.454.light.4.raw

SEQ ID NO: 566535 - DNA, 496 bp, Homo sapiens; identical to SEQ ID NO: 538625
  misc_feature: HIJSMM301BUNNH.2.49.E05.1.454.light.4.raw

SEQ ID NO: 566536 - DNA, 496 bp, Homo sapiens; identical to SEQ ID NO: 535109
  misc_feature: HIJSMM301B5ZBR.16.78.H01.1.454.light.4.raw

SEQ ID NO: 566537 - DNA, 491 bp, Homo sapiens; identical to SEQ ID NO: 535176
  misc_feature: HIJSMM301ENAF6.13.39.D06.1.454.light.4.raw

SEQ ID NO: 566538 - DNA, 487 bp, Homo sapiens
  misc_feature: HIJSMM301DVYTX.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagattttgcaacttactaactgtcaacagagttacggtaccccgtacacttttggccaggggaccaaactggacatcaaacgaactgtggctgcacatctgtt

SEQ ID NO: 566539 - DNA, 521 bp, Homo sapiens; identical to SEQ ID NO: 539470
  misc_feature: HIJSMM301BSZDN.27.23.C01.1.454.light.4.raw

SEQ ID NO: 566540 - DNA, 504 bp, Homo sapiens; identical to SEQ ID NO: 564857
  misc_feature: HIJSMM301BF23W.19.85.H08.1.454.light.4.raw

SEQ ID NO: 566541 - DNA, 499 bp, Homo sapiens
  misc_feature: HIJSMM301A1T0L.48.71.G05.1.454.light.4.raw
agtatacatacacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 566542 - DNA, 498 bp, Homo sapiens
  misc_feature: HIJSMM301CSZVD.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgactgtggctgcaccatctgtcttcatcttcccg

SEQ ID NO: 566543 - DNA, 484 bp, Homo sapiens; identical to SEQ ID NO: 540581
  misc_feature: HIJSMM301AHJZ9.3.88.H11.1.454.light.4.raw

SEQ ID NO: 566544 - DNA, 483 bp, Homo sapiens
  misc_feature: HIJSMM301EQQL7.48.73.G07.1.454.light.4.raw
agtatacatacacgaccggtgctcgatttagctctacgctcagggcacgaccggtgctcgatttagtacacgtgattagggattgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggc

SEQ ID NO: 566545 - DNA, 491 bp, Homo sapiens; identical to SEQ ID NO: 536693
  misc_feature: HIJSMM301E2PVC.19.83.H06.1.454.light.4.raw

SEQ ID NO: 566546 - DNA, 486 bp, Homo sapiens; identical to SEQ ID NO: 535917
  misc_feature: HIJSMM301BZ9MS.3.10.A10.1.454.light.4.raw

SEQ ID NO: 566547 - DNA, 486 bp, Homo sapiens; identical to SEQ ID NO: 535385
  misc_feature: HIJSMM301AF9L7.19.71.G05.1.454.light.4.raw

SEQ ID NO: 566548 - DNA, 508 bp, Homo sapiens
  misc_feature: HIJSMM301AU45O.48.35.D02.1.454.light.4.raw
agtatacatacacgaccggtgctcgatttagcacacgatagttgggtttgggcttgatgccttggggtgggaggagagacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccctcctcctatgtatact

SEQ ID NO: 566549 - DNA, 506 bp, Homo sapiens; identical to SEQ ID NO: 536355
  misc_feature: HIJSMM301ED3IS.47.85.H08.1.454.light.4.raw

SEQ ID NO: 566550 - DNA, 507 bp, Homo sapiens
  misc_feature: HIJSMM301A5OIY.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactagtggctgcaccatctgt

SEQ ID NO: 566551 - DNA, 485 bp, Homo sapiens
  misc_feature: HIJSMM301BMHX7.53.34.D01.1.454.light.4.raw
cgcgtatacacacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctcg

SEQ ID NO: 566552 - DNA, 503 bp, Homo sapiens; identical to SEQ ID NO: 538884
  misc_feature: HIJSMM301C0L8L.27.78.H01.1.454.light.4.raw

SEQ ID NO: 566553 - DNA, 503 bp, Homo sapiens
  misc_feature: HIJSMM301DX8XP.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctcgccccctc

SEQ ID NO: 566554 - DNA, 507 bp, Homo sapiens
  misc_feature: HIJSMM301APCCX.51.57.F02.1.454.light.4.raw
cgatcgtatacacgaccggtgctcgatttagctcgatatagttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccagggaccaagctcgagatcaaacgaactgtggctgcaccatctgtctt

SEQ ID NO: 566555 - DNA, 488 bp, Homo sapiens
  misc_feature: HIJSMM301B54U9.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 566556 - DNA, 502 bp, Homo sapiens
  misc_feature: HIJSMM301A8SKE.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccctac

SEQ ID NO: 566557 - DNA, 475 bp, Homo sapiens
  misc_feature: HIJSMM301EL4MF.40.23.C01.1.454.light.4.raw
tctagcgactcacgaccggtgctcgatttagtacacgtgattagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 566558 - DNA, 503 bp, Homo sapiens; identical to SEQ ID NO: 542388
  misc_feature: HIJSMM301CFQ8O.7.71.G05.1.454.light.4.raw

SEQ ID NO: 566559 - DNA, 509 bp, Homo sapiens
  misc_feature: HIJSMM301CFDBL.52.15.B04.1.454.light.4.raw
cgcagtacgacacgaccggtgctcgatttagacagtatatatccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcggggaccaaactgaccgtccttcgtctagccacggacgcgcccctccggtcc

SEQ ID NO: 566560 - DNA, 351 bp, Homo sapiens
  misc_feature: HIJSMM301C6ZY8.41.11.A11.1.454.light.4.raw
tctatactatcacgaccggtgctcgatttagctacgactgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcgggaacttttggtccaggggaccaagctggagatcagacgaactgtggctgcaccatctgtcttcatcttcccgccatctgaatagtataga

SEQ ID NO: 566561 - DNA, 503 bp, Homo sapiens; identical to SEQ ID NO: 538884
  misc_feature: HIJSMM301CSQK5.27.78.H01.1.454.light.4.raw

SEQ ID NO: 566562 - DNA, 503 bp, Homo sapiens
  misc_feature: HIJSMM301AZA66.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcgggcgggggaccgaaggtggagttcaaacgaactgtggctgcaccatctgtcttcatcttcccg

SEQ ID NO: 566563 - DNA, 494 bp, Homo sapiens; identical to SEQ ID NO: 545977
  misc_feature: HIJSMM301A48U5.18.11.A11.1.454.light.4.raw

SEQ ID NO: 566564 - DNA, 497 bp, Homo sapiens
  misc_feature: HIJSMM301B1CNI.47.64.F09.1.454.light.4.raw
agctcacgtacacgaccggtgctcgatttagcgcgtatacaagggggaggaactggctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaacgtgtggctggcaccatctgtcttcatt

SEQ ID NO: 566565 - DNA, 492 bp, Homo sapiens
  misc_feature: HIJSMM301E29MH.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggtccaacggacgacgacctggagattaaacgaactagtggcgtgcaccatctgtt

SEQ ID NO: 566566 - DNA, 515 bp, Homo sapiens
  misc_feature: HIJSMM301EQDQE.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctggtcactctgttcccgcccttctcg

SEQ ID NO: 566567 - DNA, 490 bp, Homo sapiens; identical to SEQ ID NO: 542820
  misc_feature: HIJSMM301EHT14.11.12.B01.1.454.light.4.raw

SEQ ID NO: 566568 - DNA, 485 bp, Homo sapiens; identical to SEQ ID NO: 538533
  misc_feature: HIJSMM301BJTM2.47.78.H01.1.454.light.4.raw

SEQ ID NO: 566569 - DNA, 501 bp, Homo sapiens
  misc_feature: HIJSMM301CNO5D.43.38.D05.1.454.light.4.raw
tgtgagtagtcacgaccggtgctcgatttagtatctgatagttgggtttggggagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaatcaaacgaactagtggctgcaccatctgtcttcatcttcccgccta

SEQ ID NO: 566570 - DNA, 422 bp, Homo sapiens
  misc_feature: HIJSMM301DSJ5N.41.13.B02.1.454.light.4.raw
tctatactatcacgaccggtgctcgatttagtctagcgacttccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 566571 - DNA, 515 bp, Homo sapiens
  misc_feature: HIJSMM301BJ24W.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggtttttggctatttcggtggtttcggcggagggacccaggtgaccgtcctacgtcagcccaagg

SEQ ID NO: 566572 - DNA, 498 bp, Homo sapiens
  misc_feature: HIJSMM301BRJAA.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcatcgtcctaggtcagcccaaggccaacccactgtcactctgttcccgccctcctccacgagagta

SEQ ID NO: 566573 - DNA, 374 bp, Homo sapiens; identical to SEQ ID NO: 559434
  misc_feature: HIJSMM301EOLZS.49.45.E01.1.454.light.4.raw

SEQ ID NO: 566574 - DNA, 499 bp, Homo sapiens
  misc_feature: HIJSMM301A2028.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccaagg

SEQ ID NO: 566575 - DNA, 514 bp, Homo sapiens; identical to SEQ ID NO: 541418
  misc_feature: HIJSMM301AYQNF.17.33.C11.1.454.light.4.raw

SEQ ID NO: 566576 - DNA, 484 bp, Homo sapiens; identical to SEQ ID NO: 535240
  misc_feature: HIJSMM301DOQ3N.47.60.F05.1.454.light.4.raw

SEQ ID NO: 566577 - DNA, 494 bp, Homo sapiens; identical to SEQ ID NO: 535629
  misc_feature: HIJSMM301AJIQS.4.27.C05.1.454.light.4.raw

SEQ ID NO: 566578 - DNA, 483 bp, Homo sapiens
  misc_feature: HIJSMM301EXV4Q.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtactcccagccaggttcagtggcagtgggtctgggacagagttcactctcaccatcagcagcctgcagtctgaagattttgcagtttattactgtcagcactataataactggcctccgtactagttttggccaggggaccaagctggagatacaaacgaa

SEQ ID NO: 566579 - DNA, 493 bp, Homo sapiens; identical to SEQ ID NO: 535657
  misc_feature: HIJSMM301CTB8E.27.78.H01.1.454.light.4.raw

SEQ ID NO: 566580 - DNA, 491 bp, Homo sapiens
  misc_feature: HIJSMM301C2ITG.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccaggggaccgaaggtggaaagtacaaacgaactagtggctgcacca

SEQ ID NO: 566581 - DNA, 497 bp, Homo sapiens
  misc_feature: HIJSMM301ANTE5.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcaggcgggtctgggacagatttcactctcaccatcagcagcctgcaggttgaagatgtggctagtttattactgtcagcagtattatactactcctctgacgttcggccgaaggaccaaggtggagatacaaacgaactgtgctgcaccat

SEQ ID NO: 566582 - DNA, 497 bp, Homo sapiens; identical to SEQ ID NO: 545672
  misc_feature: HIJSMM301BZ6JY.2.49.E05.1.454.light.4.raw

SEQ ID NO: 566583 - DNA, 494 bp, Homo sapiens; identical to SEQ ID NO: 537003
  misc_feature: HIJSMM301BV26L.10.79.H02.1.454.light.4.raw

SEQ ID NO: 566584 - DNA, 491 bp, Homo sapiens; identical to SEQ ID NO: 536211
  misc_feature: HIJSMM301C810W.16.53.E09.1.454.light.4.raw

SEQ ID NO: 566585 - DNA, 441 bp, Homo sapiens; identical to SEQ ID NO: 550529
  misc_feature: HIJSMM301EDIVV.41.9.A09.1.454.light.4.raw

SEQ ID NO: 566586 - DNA, 492 bp, Homo sapiens
  misc_feature: HIJSMM301D0L1N.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagatacaaacgaacta

SEQ ID NO: 566587 - DNA, 505 bp, Homo sapiens; identical to SEQ ID NO: 535503
  misc_feature: HIJSMM301C8WKG.8.28.C06.1.454.light.4.raw

SEQ ID NO: 566588 - DNA, 494 bp, Homo sapiens; identical to SEQ ID NO: 534992
  misc_feature: HIJSMM301DZVBC.9.1.A01.1.454.light.4.raw

SEQ ID NO: 566589 - DNA, 446 bp, Homo sapiens
  misc_feature: HIJSMM301DJBSS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgagatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 566590 - DNA, 520 bp, Homo sapiens; identical to SEQ ID NO: 537173
  misc_feature: HIJSMM301AW31G.27.23.C01.1.454.light.4.raw

SEQ ID NO: 566591 - DNA, 501 bp, Homo sapiens; identical to SEQ ID NO: 535746
  misc_feature: HIJSMM301AMTCU.18.11.A11.1.454.light.4.raw

SEQ ID NO: 566592 - DNA, 503 bp, Homo sapiens; identical to SEQ ID NO: 540136
  misc_feature: HIJSMM301E01ZD.19.10.A10.1.454.light.4.raw

SEQ ID NO: 566593 - DNA, 495 bp, Homo sapiens; identical to SEQ ID NO: 538651
  misc_feature: HIJSMM301C3PCY.10.79.H02.1.454.light.4.raw

SEQ ID NO: 566594 - DNA, 508 bp, Homo sapiens; identical to SEQ ID NO: 552623
  misc_feature: HIJSMM301CEX1O.17.33.C11.1.454.light.4.raw

SEQ ID NO: 566595 - DNA, 486 bp, Homo sapiens
  misc_feature: HIJSMM301EN5ID.40.83.H06.1.454.light.4.raw
tctagcgactcacgaccggtgctcgatttagatcacgtgcgtcgcggggcaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagccccg

SEQ ID NO: 566596 - DNA, 484 bp, Homo sapiens
  misc_feature: HIJSMM301CHRXP.4.42.D09.1.454.light.4.raw
agcactgtagcacgaccggtgctcgatttagacacatacgcagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccagcagaaacctggccaggctcccaggctcctcattcatggtgcatctaacagggccgatggcatcccagccaggttcagtggcagtggatatgggacagacttcactctcaccatcagcagtctgcagtctgaagattttgctagtttatttctgtcagcagtttaacacctggcctggaagttttggccaggggaccaagctggagctcaaacgaactgtggctgcacc

SEQ ID NO: 566597 - DNA, 486 bp, Homo sapiens; identical to SEQ ID NO: 535043
  misc_feature: HIJSMM301A2STJ.46.35.D02.1.454.light.4.raw

SEQ ID NO: 566598 - DNA, 490 bp, Homo sapiens; identical to SEQ ID NO: 536909
  misc_feature: HIJSMM301ATP78.12.27.C05.1.454.light.4.raw

SEQ ID NO: 566599 - DNA, 481 bp, Homo sapiens
  misc_feature: HIJSMM301CSAZC.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttatactgtctacaagattacaattaccctcgaacgttcggccaagggaccaaggtcggaagtcaaacgaactgtggctgcaccat

SEQ ID NO: 566600 - DNA, 503 bp, Homo sapiens
  misc_feature: HIJSMM301DUTJK.47.83.H06.1.454.light.4.raw
agctcacgtacacgaccggtgctcgatttagatcacgtgcgtcgcggggaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtggcttgagctctggctcagtctccactacatactcccccagctggtaccagcagaccccggaccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtcg

SEQ ID NO: 566601 - DNA, 506 bp, Homo sapiens; identical to SEQ ID NO: 539434
  misc_feature: HIJSMM301B3HKC.48.71.G05.1.454.light.4.raw

SEQ ID NO: 566602 - DNA, 487 bp, Homo sapiens; identical to SEQ ID NO: 561312
  misc_feature: HIJSMM301ENMGJ.3.12.B01.1.454.light.4.raw

SEQ ID NO: 566603 - DNA, 498 bp, Homo sapiens
  misc_feature: HIJSMM301BKMYF.15.83.H06.1.454.light.4.raw
  modified_base (483)..(483): a, c, t, g, unknown or other
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtggacatccaggatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgtcaggaccgaaggtaggacgatcaaacgaactacgtggcgtncgaccaatctgtctt

SEQ ID NO: 566604 - DNA, 493 bp, Homo sapiens
  misc_feature: HIJSMM301DL9A9.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaacgtaggacgatcaagcgaactgtggctgcaccact

SEQ ID NO: 566605 - DNA, 446 bp, Homo sapiens
  misc_feature: HIJSMM301E3F1M.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccacccctcctccgtcgtctgat

SEQ ID NO: 566606 - DNA, 484 bp, Homo sapiens; identical to SEQ ID NO: 535400
  misc_feature: HIJSMM301EWJV4.46.26.C04.1.454.light.4.raw

SEQ ID NO: 566607 - DNA, 509 bp, Homo sapiens; identical to SEQ ID NO: 542468
  misc_feature: HIJSMM301CGY49.8.33.C11.1.454.light.4.raw

SEQ ID NO: 566608 - DNA, 484 bp, Homo sapiens; identical to SEQ ID NO: 542211
  misc_feature: HIJSMM301BPKIU.13.36.D03.1.454.light.4.raw

SEQ ID NO: 566609 - DNA, 482 bp, Homo sapiens; identical to SEQ ID NO: 548071
  misc_feature: HIJSMM301ESAB6.4.74.G08.1.454.light.4.raw

SEQ ID NO: 566610 - DNA, 488 bp, Homo sapiens
  misc_feature: HIJSMM301DBFBG.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctacccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgtt

SEQ ID NO: 566611 - DNA, 480 bp, Homo sapiens
  misc_feature: HIJSMM301DJFYG.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagatttgcaacttactactgtcaacagagttacaatacccctcggctcactttcggcggagggaccaaggtgagatcaaacgaactgtggctgcaccat

SEQ ID NO: 566612 - DNA, 476 bp, Homo sapiens; identical to SEQ ID NO: 537368
  misc_feature: HIJSMM301AJVTJ.7.83.H06.1.454.light.4.raw

SEQ ID NO: 566613 - DNA, 505 bp, Homo sapiens; identical to SEQ ID NO: 546412
  misc_feature: HIJSMM301D72WB.22.21.B10.1.454.light.4.raw

SEQ ID NO: 566614 - DNA, 495 bp, Homo sapiens
  misc_feature: HIJSMM301DVDNU.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaaccaactgtggctgcaccatctgtcttcatcttcccgcc

SEQ ID NO: 566615 - DNA, 502 bp, Homo sapiens; identical to SEQ ID NO: 539341
  misc_feature: HIJSMM301D0LWK.40.41.D08.1.454.light.4.raw

SEQ ID NO: 566616 - DNA, 485 bp, Homo sapiens; identical to SEQ ID NO: 536695
  misc_feature: HIJSMM301DZRZL.10.1.A01.1.454.light.4.raw

SEQ ID NO: 566617 - DNA, 479 bp, Homo sapiens
  misc_feature: HIJSMM301A2K3H.41.37.D04.1.454.light.4.raw
tctatactatcacgaccggtgctcgatttagtagcatactgttgggtttggggtctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaacatagcctccctgaccattactggactccagcctgaggacgaggctgactattactgctcagcatgggacagcagcctcaatgtttgggtgttcggcggagggaccaagctgaccgtct

SEQ ID NO: 566618 - DNA, 489 bp, Homo sapiens; identical to SEQ ID NO: 536013
  misc_feature: HIJSMM301AH94D.26.23.C01.1.454.light.4.raw

SEQ ID NO: 566619 - DNA, 494 bp, Homo sapiens; identical to SEQ ID NO: 534992
  misc_feature: HIJSMM301BJLND.9.1.A01.1.454.light.4.raw

SEQ ID NO: 566620 - DNA, 478 bp, Homo sapiens
  misc_feature: HIJSMM301C2NKK.4.33.C11.1.454.light.4.raw
agcactgtagcacgaccggtgctcgatttagagtgagctcgttgggtttggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacc

SEQ ID NO: 566621 - DNA, 494 bp, Homo sapiens
  misc_feature: HIJSMM301DNVEG.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggaggatcaaacgaactgtggctgcaccatctgtt

SEQ ID NO: 566622 - DNA, 485 bp, Homo sapiens; identical to SEQ ID NO: 542735
  misc_feature: HIJSMM301BWH9C.26.45.E01.1.454.light.4.raw

SEQ ID NO: 566623 - DNA, 453 bp, Homo sapiens; identical to SEQ ID NO: 559000
  misc_feature: HIJSMM301CSLDV.19.86.H09.1.454.light.4.raw
  modified_base (435)..(435): a, c, t, g, unknown or other

SEQ ID NO: 566624 - DNA, 504 bp, Homo sapiens; identical to SEQ ID NO: 562026
  misc_feature: HIJSMM301CGGD9.9.71.G05.1.454.light.4.raw

SEQ ID NO: 566625 - DNA, 480 bp, Homo sapiens
  misc_feature: HIJSMM301AT2OZ.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagtatttttgttaaaggggaaagtaatgaagttaacactgtggatcaccttcggccaagggacacgactggagattaaacgaactgtggctgcaccatctgtcttcatcttcccgccatctgaagtatagtct

SEQ ID NO: 566626 - DNA, 513 bp, Homo sapiens; identical to SEQ ID NO: 565097
  misc_feature: HIJSMM301C2EPZ.43.23.C01.1.454.light.4.raw

SEQ ID NO: 566627 - DNA, 484 bp, Homo sapiens; identical to SEQ ID NO: 535400
  misc_feature: HIJSMM301CHU2G.46.26.C04.1.454.light.4.raw

SEQ ID NO: 566628 - DNA, 496 bp, Homo sapiens; identical to SEQ ID NO: 537925
  misc_feature: HIJSMM301AQ85W.22.14.B03.1.454.light.4.raw

SEQ ID NO: 566629 - DNA, 501 bp, Homo sapiens
  misc_feature: HIJSMM301CVEQC.43.34.D01.1.454.light.4.raw
tgtgagtagtcacgaccggtgctcgatttagatcgtctgtgttgggtttggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccctac

SEQ ID NO: 566630 - DNA, 496 bp, Homo sapiens
  misc_feature: HIJSMM301D2ZN7.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggtccgaagggaccgaaacggtgggaaatacaaacgaaactgtggctgcaccatctgtctt

SEQ ID NO: 566631 - DNA, 481 bp, Homo sapiens
  misc_feature: HIJSMM301D2DCJ.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccaaggtggaggatcaaacgaactgtggctgcacc

SEQ ID NO: 566632 - DNA, 493 bp, Homo sapiens
  misc_feature: HIJSMM301DFGUX.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactggagattaaacgaactgtggctgcaccatctgtctt

SEQ ID NO: 566633 - DNA, 470 bp, Homo sapiens
  misc_feature: HIJSMM301AJIA9.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaagtggatatcaacgaactgtggctgcaccatctgtcttcatcttcccgccat

SEQ ID NO: 566634 - DNA, 403 bp, Homo sapiens
  misc_feature: HIJSMM301CKY2C.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaacccactgtcactctgttcccgccctcctcctacagtgct

SEQ ID NO: 566635 - DNA, 445 bp, Homo sapiens; identical to SEQ ID NO: 542143
  misc_feature: HIJSMM301DVY4X.47.85.H08.1.454.light.4.raw

SEQ ID NO: 566636 - DNA, 520 bp, Homo sapiens; identical to SEQ ID NO: 546048
  misc_feature: HIJSMM301CCBQ5.27.23.C01.1.454.light.4.raw

SEQ ID NO: 566637 - DNA, 501 bp, Homo sapiens; identical to SEQ ID NO: 555276
  misc_feature: HIJSMM301DJERW.22.21.B10.1.454.light.4.raw

SEQ ID NO: 566638 - DNA, 481 bp, Homo sapiens
  misc_feature: HIJSMM301EI9DC.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactgctgtcagcaggctaacaggctgcccccaaccttcggccaggggacacgactggagattaaacgaactgtggctgcaccat

SEQ ID NO: 566639 - DNA, 506 bp, Homo sapiens
  misc_feature: HIJSMM301AG1XY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccgaaggtggaaagtacaaacgaactagtggctgcaccatctgtcttctatcttccccg

SEQ ID NO: 566640 - DNA, 498 bp, Homo sapiens
  misc_feature: HIJSMM301BCK8J.43.66.F11.1.454.light.4.raw
tgtgagtagtcacgaccggtgctcgatttagtcacgcgagaaagggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 566641 - DNA, 493 bp, Homo sapiens; identical to SEQ ID NO: 535084
  misc_feature: HIJSMM301EJR4B.47.64.F09.1.454.light.4.raw

SEQ ID NO: 566642 - DNA, 510 bp, Homo sapiens
  misc_feature: HIJSMM301CQMR0.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctgccccctc

SEQ ID NO: 566643 - DNA, 481 bp, Homo sapiens; identical to SEQ ID NO: 535993
  misc_feature: HIJSMM301AS33A.21.25.C03.1.454.light.4.raw

SEQ ID NO: 566644 - DNA, 504 bp, Homo sapiens
  misc_feature: HIJSMM301BG0V6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcacatctgtcttcatcttcccgcc

SEQ ID NO: 566645 - DNA, 503 bp, Homo sapiens
  misc_feature: HIJSMM301EP4GX.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaagtcaaacgaactagtggctgcaccatctgtcttcta

SEQ ID NO: 566646 - DNA, 483 bp, Homo sapiens
  misc_feature: HIJSMM301DBUW9.51.76.G10.1.454.light.4.raw
  modified_base (458)..(458): a, c, t, g, unknown or other
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaagggaccaagcgaagtnaacgactaagtagcgtggctcgcta

SEQ ID NO: 566647 - DNA, 502 bp, Homo sapiens
  misc_feature: HIJSMM301D6R05.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagccccaaggcctgccccctcggtccactctcgttccccaccctcctc

SEQ ID NO: 566648 - DNA, 514 bp, Homo sapiens; identical to SEQ ID NO: 538153
  misc_feature: HIJSMM301DE1V7.17.37.D04.1.454.light.4.raw

SEQ ID NO: 566649 - DNA, 498 bp, Homo sapiens; identical to SEQ ID NO: 535974
  misc_feature: HIJSMM301CWLJL.22.27.C05.1.454.light.4.raw

SEQ ID NO: 566650 - DNA, 493 bp, Homo sapiens
  misc_feature: HIJSMM301EDZA1.49.27.C05.1.454.light.4.raw
agtcgagagacacgaccggtgctcgatttagacgcgatcgaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 566651 - DNA, 513 bp, Homo sapiens
  misc_feature: HIJSMM301EZ3FC.47.83.H06.1.454.light.4.raw
agctcacgtacacgaccggtgctcgatttagatcacgtgcgtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 566652 - DNA, 477 bp, Homo sapiens
  misc_feature: HIJSMM301BQ09O.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggg

SEQ ID NO: 566653 - DNA, 472 bp, Homo sapiens; identical to SEQ ID NO: 535898
  misc_feature: HIJSMM301A5VDD.15.8.A08.1.454.light.4.raw

SEQ ID NO: 566654 - DNA, 491 bp, Homo sapiens
  misc_feature: HIJSMM301DLJ7P.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagccc

SEQ ID NO: 566655 - DNA, 512 bp, Homo sapiens
  misc_feature: HIJSMM301B2LUU.9.12.B01.1.454.light.4.raw
  modified_base (423)..(423): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttctcgggcgttcggtccaagggaccgaacggtaggaaatacaaacgaactagtggtctgcaccatcctgtcttctatcttccccg

SEQ ID NO: 566656 - DNA, 484 bp, Homo sapiens
  misc_feature: HIJSMM301C7ES2.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggaggaccgaaggtggaggatcaaacgaactgtggctgcacca

SEQ ID NO: 566657 - DNA, 510 bp, Homo sapiens
  misc_feature: HIJSMM301BS2WB.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttgggtccctgatcgcttctctggctccatccttgggaacaaggctgccctcaccatcacgggggcccaggcagatgatgaatctaattatcactgtgcgttgtattatgggttttggctatttcggtgttcggcgggagggacccaggtcgaccgtcctacgtcagccc

SEQ ID NO: 566658 - DNA, 518 bp, Homo sapiens
  misc_feature: HIJSMM301EQ7PX.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgcctcct

SEQ ID NO: 566659 - DNA, 486 bp, Homo sapiens; identical to SEQ ID NO: 535043
  misc_feature: HIJSMM301C2TFV.46.35.D02.1.454.light.4.raw

SEQ ID NO: 566660 - DNA, 488 bp, Homo sapiens
  misc_feature: HIJSMM301AKKQ2.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgcaacttattactgtcaacactttaacaattacctcataagccgttcggccaagggacccaggtggaaaccaagcgaactgt

SEQ ID NO: 566661 - DNA, 495 bp, Homo sapiens
  misc_feature: HIJSMM301EN0QI.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacatcaagcgaactagtggctgcaccactctgtt

SEQ ID NO: 566662 - DNA, 501 bp, Homo sapiens; identical to SEQ ID NO: 548645
  misc_feature: HIJSMM301DYSFM.14.23.C01.1.454.light.4.raw

SEQ ID NO: 566663 - DNA, 484 bp, Homo sapiens
  misc_feature: HIJSMM301CN71V.49.55.E11.1.454.light.4.raw
agtcgagagacacgaccggtgctcgatttagcactcgcacgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacg

SEQ ID NO: 566664 - DNA, 479 bp, Homo sapiens; identical to SEQ ID NO: 537141
  misc_feature: HIJSMM301ARNGL.7.76.G10.1.454.light.4.raw

SEQ ID NO: 566665 - DNA, 492 bp, Homo sapiens
  misc_feature: HIJSMM301EMHOI.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaactgtggctgcaccatctgtt

SEQ ID NO: 566666 - DNA, 502 bp, Homo sapiens
  misc_feature: HIJSMM301BLL36.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtctcggtcagcccaaggctgccccc

SEQ ID NO: 566667 - DNA, 494 bp, Homo sapiens; identical to SEQ ID NO: 534994
  misc_feature: HIJSMM301BCQUG.27.78.H01.1.454.light.4.raw

SEQ ID NO: 566668 - DNA, 487 bp, Homo sapiens; identical to SEQ ID NO: 539157
  misc_feature: HIJSMM301EJ8BH.26.37.D04.1.454.light.4.raw

SEQ ID NO: 566669 - DNA, 496 bp, Homo sapiens; identical to SEQ ID NO: 537925
  misc_feature: HIJSMM301BETWA.22.14.B03.1.454.light.4.raw

SEQ ID NO: 566670 - DNA, 494 bp, Homo sapiens; identical to SEQ ID NO: 537805
  misc_feature: HIJSMM301AXPFT.51.6.A06.1.454.light.4.raw

SEQ ID NO: 566671 - DNA, 494 bp, Homo sapiens; identical to SEQ ID NO: 534992
  misc_feature: HIJSMM301AQPL8.9.1.A01.1.454.light.4.raw

SEQ ID NO: 566672 - DNA, 507 bp, Homo sapiens
  misc_feature: HIJSMM301AIXDZ.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttgggtttttggcggcgggacccagatgactgtcctcagtcagcccaaggctgccccctcggt

SEQ ID NO: 566673 - DNA, 497 bp, Homo sapiens; identical to SEQ ID NO: 535664
  misc_feature: HIJSMM301BOF2M.22.14.B03.1.454.light.4.raw

SEQ ID NO: 566674 - DNA, 495 bp, Homo sapiens; identical to SEQ ID NO: 535596
  misc_feature: HIJSMM301DT35W.10.79.H02.1.454.light.4.raw

SEQ ID NO: 566675 - DNA, 489 bp, Homo sapiens; identical to SEQ ID NO: 545815
  misc_feature: HIJSMM301EN9U9.4.24.C02.1.454.light.4.raw

SEQ ID NO: 566676 - DNA, 505 bp, Homo sapiens; identical to SEQ ID NO: 536233
  misc_feature: HIJSMM301A6KQ2.48.25.C03.1.454.light.4.raw

SEQ ID NO: 566677 - DNA, 488 bp, Homo sapiens; identical to SEQ ID NO: 537673
  misc_feature: HIJSMM301AMIFI.12.31.C09.1.454.light.4.raw

SEQ ID NO: 566678 - DNA, 486 bp, Homo sapiens
  misc_feature: HIJSMM301C2MT4.7.75.G09.1.454.light.4.raw
  modified_base (392)..(392): a, c, t, g, unknown or other
  modified_base (440)..(440): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggatttgtnaactactaactgtcagcagcaacaggacgtcgccccaccctaccgccncggacggagaccgacgaggagtaagtaaacgtaacgtagtacgtgg

SEQ ID NO: 566679 - DNA, 504 bp, Homo sapiens
  misc_feature: HIJSMM301ESRYA.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgataacgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 566680 - DNA, 486 bp, Homo sapiens; identical to SEQ ID NO: 535458
  misc_feature: HIJSMM301DGTN9.7.75.G09.1.454.light.4.raw

SEQ ID NO: 566681 - DNA, 503 bp, Homo sapiens; identical to SEQ ID NO: 538884
  misc_feature: HIJSMM301BFY1T.27.78.H01.1.454.light.4.raw

SEQ ID NO: 566682 - DNA, 506 bp, Homo sapiens; identical to SEQ ID NO: 542696
  misc_feature: HIJSMM301D7EFB.7.71.G05.1.454.light.4.raw

SEQ ID NO: 566683 - DNA, 491 bp, Homo sapiens
  misc_feature: HIJSMM301C2KUR.49.73.G07.1.454.light.4.raw
agtcgagagacacgaccggtgctcgatttagctctacgctcagggcacgaccggtgctcgatttagacgcgatcgaagggtttggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttacttcaccatcatcaacctgcagcctgaggatattgcaacatattactgtacaacaatatgataatctaccactcactttcggcggagggaccacggtaggagata

SEQ ID NO: 566684 - DNA, 448 bp, Homo sapiens
  misc_feature: HIJSMM301BPJSO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccactactcgta

SEQ ID NO: 566685 - DNA, 487 bp, Homo sapiens
  misc_feature: HIJSMM301DF86Z.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgccacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggaggatcaaacgtaac

SEQ ID NO: 566686 - DNA, 496 bp, Homo sapiens; identical to SEQ ID NO: 537925
  misc_feature: HIJSMM301BFZ8M.22.14.B03.1.454.light.4.raw

SEQ ID NO: 566687 - DNA, 502 bp, Homo sapiens
  misc_feature: HIJSMM301C8VZG.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaacccatgtca

SEQ ID NO: 566688 - DNA, 485 bp, Homo sapiens; identical to SEQ ID NO: 543370
  misc_feature: HIJSMM301DX4D1.3.10.A10.1.454.light.4.raw

SEQ ID NO: 566689 - DNA, 504 bp, Homo sapiens
  misc_feature: HIJSMM301D7Q6K.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccggagtgttcggcggagggaccaagctgaccgtcctaggtcagcccaaggcagccccctcggtcactc

SEQ ID NO: 566690 - DNA, 486 bp, Homo sapiens
  misc_feature: HIJSMM301CIE66.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgatttattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 566691 - DNA, 484 bp, Homo sapiens; identical to SEQ ID NO: 535400
  misc_feature: HIJSMM301EDK6K.46.26.C04.1.454.light.4.raw

SEQ ID NO: 566692 - DNA, 513 bp, Homo sapiens
  misc_feature: HIJSMM301CIB6J.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgtt

SEQ ID NO: 566693 - DNA, 484 bp, Homo sapiens; identical to SEQ ID NO: 535441
  misc_feature: HIJSMM301AUP9V.26.60.F05.1.454.light.4.raw

SEQ ID NO: 566694 - DNA, 495 bp, Homo sapiens; identical to SEQ ID NO: 538673
  misc_feature: HIJSMM301A5NVG.51.35.D02.1.454.light.4.raw

SEQ ID NO: 566695 - DNA, 510 bp, Homo sapiens
  misc_feature: HIJSMM301BK30J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaagggaccgaaggtaggaaatacaaaacgaactagtggctgcaccatctgtcttcatcttccccg

SEQ ID NO: 566696 - DNA, 506 bp, Homo sapiens; identical to SEQ ID NO: 553862
  misc_feature: HIJSMM301BYMPE.10.88.H11.1.454.light.4.raw

SEQ ID NO: 566697 - DNA, 501 bp, Homo sapiens; identical to SEQ ID NO: 542488
  misc_feature: HIJSMM301EUKMB.19.78.H01.1.454.light.4.raw

SEQ ID NO: 566698 - DNA, 489 bp, Homo sapiens; identical to SEQ ID NO: 535139
  misc_feature: HIJSMM301C1CDU.14.55.E11.1.454.light.4.raw

SEQ ID NO: 566699 - DNA, 491 bp, Homo sapiens
  misc_feature: HIJSMM301C80UH.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttatactgtcagcaatatgaaagtattccttttactttcggcccctgggaccaaagtggatatcaaacgaactgtggctgcaccat

SEQ ID NO: 566700 - DNA, 504 bp, Homo sapiens; identical to SEQ ID NO: 540689
  misc_feature: HIJSMM301BDVZB.21.38.D05.1.454.light.4.raw

SEQ ID NO: 566701 - DNA, 496 bp, Homo sapiens
  misc_feature: HIJSMM301COCYY.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacctttcggccaagggacacgactggagattaaacgaactgtggctgcaccatctgtt

SEQ ID NO: 566702 - DNA, 485 bp, Homo sapiens; identical to SEQ ID NO: 535501
  misc_feature: HIJSMM301DN2UI.3.10.A10.1.454.light.4.raw

SEQ ID NO: 566703 - DNA, 503 bp, Homo sapiens
  misc_feature: HIJSMM301CZFRC.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggcctgccccctc

SEQ ID NO: 566704 - DNA, 488 bp, Homo sapiens; identical to SEQ ID NO: 535990
  misc_feature: HIJSMM301DOZMH.11.28.C06.1.454.light.4.raw

SEQ ID NO: 566705 - DNA, 520 bp, Homo sapiens
  misc_feature: HIJSMM301D8KHV.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtacggaaagtacaagacgaaacgtacgtaggcgtgcgaccactctgtcttctatcttcccgt

SEQ ID NO: 566706 - DNA, 472 bp, Homo sapiens; identical to SEQ ID NO: 536302
  misc_feature: HIJSMM301ANW1F.18.76.G10.1.454.light.4.raw

SEQ ID NO: 566707 - DNA, 488 bp, Homo sapiens; identical to SEQ ID NO: 539884
  misc_feature: HIJSMM301C06NU.7.85.H08.1.454.light.4.raw

SEQ ID NO: 566708 - DNA, 488 bp, Homo sapiens; identical to SEQ ID NO: 537260
  misc_feature: HIJSMM301CNX4Q.47.70.G04.1.454.light.4.raw

SEQ ID NO: 566709 - DNA, 469 bp, Homo sapiens
  misc_feature: HIJSMM301B9GGS.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtccgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaa

SEQ ID NO: 566710 - DNA, 495 bp, Homo sapiens; identical to SEQ ID NO: 535007
  misc_feature: HIJSMM301BJ749.22.5.A05.1.454.light.4.raw

SEQ ID NO: 566711 - DNA, 491 bp, Homo sapiens
  misc_feature: HIJSMM301CTZ6D.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttccgccat

SEQ ID NO: 566712 - DNA, 497 bp, Homo sapiens
  misc_feature: HIJSMM301DLTVQ.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcatttctgggcatctacccgggaatccggggtccctgagcgattcagtggcagcgggtctgggacagatttcactttcaccatcagcagcctgcaggctgaagatgtggcagttattactgtcagcaatattatagtactccctacacttttggccaggggaccaagctggagatcaaacgaactgtggctgcacc

SEQ ID NO: 566713 - DNA, 482 bp, Homo sapiens
  misc_feature: HIJSMM301AYAFT.48.12.B01.1.454.light.4.raw
agtatacatacacgaccggtgctcgatttagtagtgtagattccgcgggggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccatctgtcttcatcttcccgccat

SEQ ID NO: 566714 - DNA, 505 bp, Homo sapiens; identical to SEQ ID NO: 536254
  misc_feature: HIJSMM301A8A73.7.71.G05.1.454.light.4.raw

SEQ ID NO: 566715 - DNA, 494 bp, Homo sapiens; identical to SEQ ID NO: 534992
  misc_feature: HIJSMM301CPJ9F.9.1.A01.1.454.light.4.raw

SEQ ID NO: 566716 - DNA, 503 bp, Homo sapiens
  misc_feature: HIJSMM301C6SLY.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggngttcggcggagggccaaactgaccgtcctaggtccagcccaa

SEQ ID NO: 566717 - DNA, 486 bp, Homo sapiens; identical to SEQ ID NO: 550554
  misc_feature: HIJSMM301DMHDV.3.55.E11.1.454.light.4.raw

SEQ ID NO: 566718 - DNA, 487 bp, Homo sapiens; identical to SEQ ID NO: 537079
  misc_feature: HIJSMM301D8TG7.14.55.E11.1.454.light.4.raw

SEQ ID NO: 566719 - DNA, 506 bp, Homo sapiens
  misc_feature: HIJSMM301CMHUG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcctcgggcgttcggccaagggaccgaaggtggaaatcaaacgaactagtggctgcaccatctgtcttctatcttccccg

SEQ ID NO: 566720 - DNA, 504 bp, Homo sapiens
  misc_feature: HIJSMM301BGPQJ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctcctcg

SEQ ID NO: 566721 - DNA, 505 bp, Homo sapiens
  misc_feature: HIJSMM301A0V69.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcactctgttccccg

SEQ ID NO: 566722 - DNA, 487 bp, Homo sapiens; identical to SEQ ID NO: 539157
  misc_feature: HIJSMM301B01HZ.26.37.D04.1.454.light.4.raw

SEQ ID NO: 566723 - DNA, 498 bp, Homo sapiens
  misc_feature: HIJSMM301CANK4.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 566724 - DNA, 506 bp, Homo sapiens
  misc_feature: HIJSMM301DP2NQ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggaggaccgaaggtggagatcaaacgaactgtggctgcaccatctgtt

SEQ ID NO: 566725 - DNA, 523 bp, Homo sapiens
  misc_feature: HIJSMM301AYGS3.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccct

SEQ ID NO: 566726 - DNA, 486 bp, Homo sapiens
  misc_feature: HIJSMM301E0L1Z.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgaccctcctctacgtgagct

SEQ ID NO: 566727 - DNA, 512 bp, Homo sapiens
  misc_feature: HIJSMM301BHSQM.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatgttcgggactgggaccaaggtcaccgtcctaggtcagcccaaggccaacccactgtcactctcg

SEQ ID NO: 566728 - DNA, 494 bp, Homo sapiens
  misc_feature: HIJSMM301E2U6P.9.1.A01.1.454.light.4.raw
  modified_base (445)..(445): a, c, t, g, unknown or other
  modified_base (447)..(447): a, c, t, g, unknown or other
  modified_base (467)..(467): a, c, t, g, unknown or other
  modified_base (477)..(477): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacacctcgtcgacggagacgacngngataagtaacgtagtgcgcngaccactctntcgttctactcttcccg

SEQ ID NO: 566729 - DNA, 489 bp, Homo sapiens; identical to SEQ ID NO: 535139
  misc_feature: HIJSMM301CO0KA.14.55.E11.1.454.light.4.raw

SEQ ID NO: 566730 - DNA, 480 bp, Homo sapiens
  misc_feature: HIJSMM301EDS3W.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccaaggtggagatcaaacgaactgtggctgcacc

SEQ ID NO: 566731 - DNA, 502 bp, Homo sapiens; identical to SEQ ID NO: 541971
  misc_feature: HIJSMM301DDDST.4.39.D06.1.454.light.4.raw

SEQ ID NO: 566732 - DNA, 479 bp, Homo sapiens
  misc_feature: HIJSMM301BGYHA.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagcccg

SEQ ID NO: 566733 - DNA, 490 bp, Homo sapiens
  misc_feature: HIJSMM301CSBD1.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactagtggctgcaccatctgtcttcta

SEQ ID NO: 566734 - DNA, 485 bp, Homo sapiens; identical to SEQ ID NO: 542735
  misc_feature: HIJSMM301BVPYS.26.45.E01.1.454.light.4.raw

SEQ ID NO: 566735 - DNA, 491 bp, Homo sapiens
  misc_feature: HIJSMM301DYL54.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggaccgaagggacacgactggagtaattaaacgaactggtgctgcaccatctgtt

SEQ ID NO: 566736 - DNA, 494 bp, Homo sapiens
  misc_feature: HIJSMM301CTFGM.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagttattactgtcagcaatattttcgtgctccgtacacttttggccaggggacccaggtggagatcagacgaactgtggctgcaccatctgtcttcatcttcccg

SEQ ID NO: 566737 - DNA, 495 bp, Homo sapiens; identical to SEQ ID NO: 539326
  misc_feature: HIJSMM301BTXWU.52.86.H09.1.454.light.4.raw

SEQ ID NO: 566738 - DNA, 487 bp, Homo sapiens; identical to SEQ ID NO: 536006
  misc_feature: HIJSMM301CXXVC.4.64.F09.1.454.light.4.raw

SEQ ID NO: 566739 - DNA, 454 bp, Homo sapiens; identical to SEQ ID NO: 534964
  misc_feature: HIJSMM301C29U9.19.86.H09.1.454.light.4.raw

SEQ ID NO: 566740 - DNA, 494 bp, Homo sapiens; identical to SEQ ID NO: 539784
  misc_feature: HIJSMM301A65OY.22.57.F02.1.454.light.4.raw

SEQ ID NO: 566741 - DNA, 494 bp, Homo sapiens
  misc_feature: HIJSMM301A4OCU.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttggccctgggaccaaagtggaggatcaacgaaactgtggctgcaccatctgtctt

SEQ ID NO: 566742 - DNA, 510 bp, Homo sapiens; identical to SEQ ID NO: 538614
  misc_feature: HIJSMM301AFT7L.19.59.F04.1.454.light.4.raw

SEQ ID NO: 566743 - DNA, 459 bp, Homo sapiens
  misc_feature: HIJSMM301BD2RV.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgcccctcggtcactctgttcccgccctcctcacgcgtatgt

SEQ ID NO: 566744 - DNA, 503 bp, Homo sapiens; identical to SEQ ID NO: 551912
  misc_feature: HIJSMM301AEOZA.12.50.E06.1.454.light.4.raw

SEQ ID NO: 566745 - DNA, 489 bp, Homo sapiens; identical to SEQ ID NO: 535386
  misc_feature: HIJSMM301ERCBH.12.51.E07.1.454.light.4.raw

SEQ ID NO: 566746 - DNA, 466 bp, Homo sapiens; identical to SEQ ID NO: 545616
  misc_feature: HIJSMM301DHS71.40.10.A10.1.454.light.4.raw

SEQ ID NO: 566747 - DNA, 505 bp, Homo sapiens
  misc_feature: HIJSMM301A0GU3.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactc

SEQ ID NO: 566748 - DNA, 522 bp, Homo sapiens
  misc_feature: HIJSMM301A10CL.3.87.H10.1.454.light.4.raw
agacgcactccacgaccggtgctcgatttagcagtactgcgttgggtttggggggggtcgtcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggttggagggaccaagctgaccgtcctaggtcagcccaaggctcgccccctccggtcactc

SEQ ID NO: 566749 - DNA, 471 bp, Homo sapiens
  misc_feature: HIJSMM301CMOW5.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaaccgtgatgatgttgcaacatactattgtcagcaatatgattttgctcctcgagtgccacttttggcgggggtaccaaggtggacatcaaacgaa

SEQ ID NO: 566750 - DNA, 494 bp, Homo sapiens; identical to SEQ ID NO: 534994
  misc_feature: HIJSMM301DRJRO.27.78.H01.1.454.light.4.raw

SEQ ID NO: 566751 - DNA, 512 bp, Homo sapiens; identical to SEQ ID NO: 556539
  misc_feature: HIJSMM301AKFXK.5.58.F03.1.454.light.4.raw

SEQ ID NO: 566752 - DNA, 486 bp, Homo sapiens; identical to SEQ ID NO: 535043
  misc_feature: HIJSMM301EEA0V.46.35.D02.1.454.light.4.raw

SEQ ID NO: 566753 - DNA, 472 bp, Homo sapiens; identical to SEQ ID NO: 535898
  misc_feature: HIJSMM301AZLWX.15.8.A08.1.454.light.4.raw

SEQ ID NO: 566754 - DNA, 505 bp, Homo sapiens; identical to SEQ ID NO: 538422
  misc_feature: HIJSMM301CGQ8Y.19.78.H01.1.454.light.4.raw

SEQ ID NO: 566755 - DNA, 493 bp, Homo sapiens
  misc_feature: HIJSMM301DX4DD.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccagggggaccaagttggagatcaaacgaactgtgg

SEQ ID NO: 566756 - DNA, 507 bp, Homo sapiens
  misc_feature: HIJSMM301BV8KA.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctgaccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttcccgccat

SEQ ID NO: 566757 - DNA, 487 bp, Homo sapiens; identical to SEQ ID NO: 543396
  misc_feature: HIJSMM301C1PVH.46.26.C04.1.454.light.4.raw

SEQ ID NO: 566758 - DNA, 433 bp, Homo sapiens
  misc_feature: HIJSMM301BMHXB.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccagggaccaagctggagatcaaacgaactgtggctgcaccatctgtcttcatcttccgccatctgactatactcgta

SEQ ID NO: 566759 - DNA, 380 bp, Homo sapiens; identical to SEQ ID NO: 540540
  misc_feature: HIJSMM301A4IXV.12.78.H01.1.454.light.4.raw

SEQ ID NO: 566760 - DNA, 499 bp, Homo sapiens; identical to SEQ ID NO: 537739
  misc_feature: HIJSMM301EEUDM.12.86.H09.1.454.light.4.raw

SEQ ID NO: 566761 - DNA, 505 bp, Homo sapiens; identical to SEQ ID NO: 535503
  misc_feature: HIJSMM301BWFG0.8.28.C06.1.454.light.4.raw

SEQ ID NO: 566762 - DNA, 503 bp, Homo sapiens; identical to SEQ ID NO: 538256
  misc_feature: HIJSMM301B446A.19.67.G01.1.454.light.4.raw

SEQ ID NO: 566763 - DNA, 460 bp, Homo sapiens; identical to SEQ ID NO: 536053
  misc_feature: HIJSMM301AWIAG.22.28.C06.1.454.light.4.raw

SEQ ID NO: 566764 - DNA, 500 bp, Homo sapiens
  misc_feature: HIJSMM301EYVK1.48.67.G01.1.454.light.4.raw
agtatacatacacgaccggtgctcgatttagagtatacatattgggtttgggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 566765 - DNA, 509 bp, Homo sapiens; identical to SEQ ID NO: 541417
  misc_feature: HIJSMM301AI21E.16.46.E02.1.454.light.4.raw

SEQ ID NO: 566766 - DNA, 494 bp, Homo sapiens; identical to SEQ ID NO: 534992
  misc_feature: HIJSMM301AZJIS.9.1.A01.1.454.light.4.raw

SEQ ID NO: 566767 - DNA, 508 bp, Homo sapiens
  misc_feature: HIJSMM301BC2JD.8.33.C11.1.454.light.4.raw
  modified_base (252)..(252): a, c, t, g, unknown or other
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtanctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccgggggccactttcggccctgggaccaaaggtggagatcaaacgaactagtggctgcaccatctgtcttcta

SEQ ID NO: 566768 - DNA, 454 bp, Homo sapiens; identical to SEQ ID NO: 536347
  misc_feature: HIJSMM301C2AYL.19.86.H09.1.454.light.4.raw

SEQ ID NO: 566769 - DNA, 483 bp, Homo sapiens; identical to SEQ ID NO: 535778
  misc_feature: HIJSMM301A9CC0.48.84.H07.1.454.light.4.raw

SEQ ID NO: 566770 - DNA, 500 bp, Homo sapiens; identical to SEQ ID NO: 563448
  misc_feature: HIJSMM301A20CP.22.27.C05.1.454.light.4.raw

SEQ ID NO: 566771 - DNA, 447 bp, Homo sapiens; identical to SEQ ID NO: 535201
  misc_feature: HIJSMM301D0UYB.18.9.A09.1.454.light.4.raw

SEQ ID NO: 566772 - DNA, 477 bp, Homo sapiens
  misc_feature: HIJSMM301BH9KJ.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtcttctatcttcccgtccat

SEQ ID NO: 566773 - DNA, 487 bp, Homo sapiens; identical to SEQ ID NO: 544897
  misc_feature: HIJSMM301AQ8PU.46.35.D02.1.454.light.4.raw

SEQ ID NO: 566774 - DNA, 474 bp, Homo sapiens
  misc_feature: HIJSMM301E3FCK.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaggtcaccgtcctaagtcagacccg

SEQ ID NO: 566775 - DNA, 492 bp, Homo sapiens
  misc_feature: HIJSMM301CJ997.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccat

SEQ ID NO: 566776 - DNA, 515 bp, Homo sapiens
  misc_feature: HIJSMM301BOM1R.43.59.F04.1.454.light.4.raw
tgtgagtagtcacgaccggtgctcgatttagtacacacacttagggattgggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 566777 - DNA, 506 bp, Homo sapiens
  misc_feature: HIJSMM301ED6TR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatacaaacgaactagtggctgcaccactctgtcttcatcttccccg

SEQ ID NO: 566778 - DNA, 497 bp, Homo sapiens
  misc_feature: HIJSMM301C81HI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacgacgactggagattaaaggaactagtggctgcaccactctgtcttctatcttccccg

SEQ ID NO: 566779 - DNA, 441 bp, Homo sapiens; identical to SEQ ID NO: 546257
  misc_feature: HIJSMM301ESCTG.41.9.A09.1.454.light.4.raw

SEQ ID NO: 566780 - DNA, 517 bp, Homo sapiens
  misc_feature: HIJSMM301DBI0G.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgcct

SEQ ID NO: 566781 - DNA, 495 bp, Homo sapiens; identical to SEQ ID NO: 563808
  misc_feature: HIJSMM301BHZBL.40.57.F02.1.454.light.4.raw

SEQ ID NO: 566782 - DNA, 486 bp, Homo sapiens
  misc_feature: HIJSMM301BN2IA.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaagggtgcagatcaaacgaactgtggctgcaa

SEQ ID NO: 566783 - DNA, 480 bp, Homo sapiens; identical to SEQ ID NO: 560999
  misc_feature: HIJSMM301BCYFD.21.25.C03.1.454.light.4.raw

SEQ ID NO: 566784 - DNA, 504 bp, Homo sapiens
  misc_feature: HIJSMM301CSRVO.9.53.E09.1.454.light.4.raw
  modified_base (440)..(440): a, c, t, g, unknown or other
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggtctgacgacgaggctgattattactgctagctcatatgcagtgttcgtnttcaagtctagttacgtcggagggacgacggacgtgaccgtcctaggacgtcgacgaccgaagg

SEQ ID NO: 566785 - DNA, 497 bp, Homo sapiens; identical to SEQ ID NO: 551301
  misc_feature: HIJSMM301A0N4E.15.81.H04.1.454.light.4.raw

SEQ ID NO: 566786 - DNA, 487 bp, Homo sapiens; identical to SEQ ID NO: 537079
  misc_feature: HIJSMM301C3ZQE.14.55.E11.1.454.light.4.raw

SEQ ID NO: 566787 - DNA, 497 bp, Homo sapiens
  misc_feature: HIJSMM301ET15I.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccc

SEQ ID NO: 566788 - DNA, 383 bp, Homo sapiens; identical to SEQ ID NO: 447524
  misc_feature: HIJSMM301BRPR9.41.26.C04.1.454.light.4.raw

SEQ ID NO: 566789 - DNA, 504 bp, Homo sapiens
  misc_feature: HIJSMM301EADX5.43.35.D02.1.454.light.4.raw
tgtgagtagtcacgaccggtgctcgatttagcacacgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccac

SEQ ID NO: 566790 - DNA, 492 bp, Homo sapiens
  misc_feature: HIJSMM301BTOCX.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcact

SEQ ID NO: 566791 - DNA, 444 bp, Homo sapiens; identical to SEQ ID NO: 535856
  misc_feature: HIJSMM301AXASA.9.9.A09.1.454.light.4.raw

SEQ ID NO: 566792 - DNA, 488 bp, Homo sapiens
  misc_feature: HIJSMM301EJRLF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 566793 - DNA, 494 bp, Homo sapiens
  misc_feature: HIJSMM301C802Y.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtataagggtgcgcttcggccaagggacacgactggaggttaaacgaactgtggctgcaccatctgtcttcatcttcccgccat

SEQ ID NO: 566794 - DNA, 496 bp, Homo sapiens
  misc_feature: HIJSMM301BSZ8U.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactgtggctgcaccatctgtcttcattcc

SEQ ID NO: 566795 - DNA, 481 bp, Homo sapiens; identical to SEQ ID NO: 535993
  misc_feature: HIJSMM301A0E4W.21.25.C03.1.454.light.4.raw

SEQ ID NO: 566796 - DNA, 461 bp, Homo sapiens
  misc_feature: HIJSMM301DTKU8.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 566797 - DNA, 505 bp, Homo sapiens
  misc_feature: HIJSMM301CGIQP.43.57.F02.1.454.light.4.raw
tgtgagtagtcacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcgcgggaccaagctgaccgtcctaggtcagcccaaggctgccccctggtcact

SEQ ID NO: 566798 - DNA, 527 bp, Homo sapiens
  misc_feature: HIJSMM301CBACT.2.81.H04.1.454.light.4.raw
acgctcgacacacgaccggtgctcgatttagtagtgtagattcgcggggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccataaaagaggctcccactgcttgtacgtacacggtttcaggttctttttcactcccctcgccggggttcttttcgcctttccctcacggtactggttcactatcggtcagtcaggagtatttagcctttggaggatggtccccccatattcagacaggataccacgtgtcccaccctcctctgtcgagcgt

SEQ ID NO: 566799 - DNA, 484 bp, Homo sapiens
  misc_feature: HIJSMM301BS5P6.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcgagggaccaaggtggaggtcaagcgaactgtggctggcaccta

SEQ ID NO: 566800 - DNA, 496 bp, Homo sapiens; identical to SEQ ID NO: 537925
  misc_feature: HIJSMM301DOD45.22.14.B03.1.454.light.4.raw

SEQ ID NO: 566801 - DNA, 521 bp, Homo sapiens
  misc_feature: HIJSMM301AKM9U.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtttccgccct

SEQ ID NO: 566802 - DNA, 487 bp, Homo sapiens; identical to SEQ ID NO: 536206
  misc_feature: HIJSMM301ESHMN.47.38.D05.1.454.light.4.raw

SEQ ID NO: 566803 - DNA, 490 bp, Homo sapiens; identical to SEQ ID NO: 537951
  misc_feature: HIJSMM301AS74P.19.57.F02.1.454.light.4.raw

SEQ ID NO: 566804 - DNA, 511 bp, Homo sapiens
  misc_feature: HIJSMM301ENNN4.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggtttcaggctccctcctcggggcaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccgccctcct

SEQ ID NO: 566805 - DNA, 483 bp, Homo sapiens
  misc_feature: HIJSMM301DV13N.52.5.A05.1.454.light.4.raw
cgcagtacgacacgaccggtgctcgatttagatagatagacaggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgcccctccggtca

SEQ ID NO: 566806 - DNA, 518 bp, Homo sapiens; identical to SEQ ID NO: 540171
  misc_feature: HIJSMM301B3PJK.49.10.A10.1.454.light.4.raw

SEQ ID NO: 566807 - DNA, 503 bp, Homo sapiens; identical to SEQ ID NO: 536760
  misc_feature: HIJSMM301EUQA9.47.55.E11.1.454.light.4.raw

SEQ ID NO: 566808 - DNA, 493 bp, Homo sapiens
  misc_feature: HIJSMM301BZA5B.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtgggtcccatctaggttcagcggcagtggatttgggacagaattcactctcaccatccgcagcctgcagcctgaagattttgcaacttattactgcaacagtataatagcaattctccgtggacgttcggccaagggaccgagggtggagtatacaaacgaactgtggctgcaccatctgtcttc

SEQ ID NO: 566809 - DNA, 500 bp, Homo sapiens
  misc_feature: HIJSMM301AMFCF.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccgaaggtggaaatacaaacgaactagtggctgcacc

SEQ ID NO: 566810 - DNA, 483 bp, Homo sapiens
  misc_feature: HIJSMM301DFS3A.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgttggttttggctgttcggcggcgggacc

SEQ ID NO: 566811 - DNA, 454 bp, Homo sapiens; identical to SEQ ID NO: 535005
  misc_feature: HIJSMM301AX0E9.19.86.H09.1.454.light.4.raw

SEQ ID NO: 566812 - DNA, 441 bp, Homo sapiens; identical to SEQ ID NO: 535074
  misc_feature: HIJSMM301ATQ5X.11.3.A03.1.454.light.4.raw

SEQ ID NO: 566813 - DNA, 498 bp, Homo sapiens
  misc_feature: HIJSMM301EAJ4A.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggcccaagggacccaaggtggaaatcaaacgaactgtggctgcaccatctgtcttcatcttcccgccat

SEQ ID NO: 566814 - DNA, 484 bp, Homo sapiens
  misc_feature: HIJSMM301DNQN8.12.88.H11.1.454.light.4.raw
atacgacgtacacgaccggtgctcgatttagcgacagcgagaacacacaaaggggtgatcaggacttctcagttcatcttctcaccatgaggctccctgctcagctcctgaggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggacg

SEQ ID NO: 566815 - DNA, 500 bp, Homo sapiens
  misc_feature: HIJSMM301EABOV.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatt

SEQ ID NO: 566816 - DNA, 457 bp, Homo sapiens; identical to SEQ ID NO: 536586
  misc_feature: HIJSMM301CJLH0.49.85.H08.1.454.light.4.raw

SEQ ID NO: 566817 - DNA, 492 bp, Homo sapiens; identical to SEQ ID NO: 545637
  misc_feature: HIJSMM301BSWLV.48.1.A01.1.454.light.4.raw

SEQ ID NO: 566818 - DNA, 508 bp, Homo sapiens
  misc_feature: HIJSMM301AOKXV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtccgtgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgaccgtcctagggtcaggcccaac

SEQ ID NO: 566819 - DNA, 489 bp, Homo sapiens
  misc_feature: HIJSMM301A763Y.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacaggggacgttcggccaagggaccaaggtggaaatcaaacgaactgtggctgcaccatctgtctt

SEQ ID NO: 566820 - DNA, 498 bp, Homo sapiens
  misc_feature: HIJSMM301EW0L4.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaaccagggaaagtccctaagctcctgatctatgttgcatccactttgcaaagtggggtcccatcaaaggttcagcggcagtggatctgggacagaattcaactctcacaatcagcagcctgcagcctgaagattttgcaacttattactgtcaacagcttaatagttacccgctccagttttcggcggagggaccaaggtggagatcaaaacggaaactgtggctgacaccatctgtt

SEQ ID NO: 566821 - DNA, 490 bp, Homo sapiens; identical to SEQ ID NO: 540741
  misc_feature: HIJSMM301CWXF4.14.55.E11.1.454.light.4.raw

SEQ ID NO: 566822 - DNA, 493 bp, Homo sapiens; identical to SEQ ID NO: 535047
  misc_feature: HIJSMM301AV7ZY.16.53.E09.1.454.light.4.raw

SEQ ID NO: 566823 - DNA, 454 bp, Homo sapiens; identical to SEQ ID NO: 534964
  misc_feature: HIJSMM301DJU4V.19.86.H09.1.454.light.4.raw

SEQ ID NO: 566824 - DNA, 492 bp, Homo sapiens; identical to SEQ ID NO: 541395
  misc_feature: HIJSMM301D872P.21.47.E03.1.454.light.4.raw

SEQ ID NO: 566825 - DNA, 486 bp, Homo sapiens; identical to SEQ ID NO: 535385
  misc_feature: HIJSMM301BHKQO.19.71.G05.1.454.light.4.raw

SEQ ID NO: 566826 - DNA, 494 bp, Homo sapiens; identical to SEQ ID NO: 540110
  misc_feature: HIJSMM301AYO2Z.51.71.G05.1.454.light.4.raw

SEQ ID NO: 566827 - DNA, 498 bp, Homo sapiens
  misc_feature: HIJSMM301BNCCO.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctcaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccc

SEQ ID NO: 566828 - DNA, 487 bp, Homo sapiens
  misc_feature: HIJSMM301AUJTQ.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtatcagacgaa

SEQ ID NO: 566829 - DNA, 503 bp, Homo sapiens; identical to SEQ ID NO: 535140
  misc_feature: HIJSMM301BZT3N.18.37.D04.1.454.light.4.raw

SEQ ID NO: 566830 - DNA, 486 bp, Homo sapiens; identical to SEQ ID NO: 535043
  misc_feature: HIJSMM301C3UGZ.46.35.D02.1.454.light.4.raw

SEQ ID NO: 566831 - DNA, 499 bp, Homo sapiens
  misc_feature: HIJSMM301C6Q1Q.48.31.C09.1.454.light.4.raw
agtatacatacacgaccggtgctcgatttagacgtctcatcaaggaaggaaggggagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattccccctccgacgttcggccaagggaccaaggtggaagtcagacgaactgtggctgcaccatctgtcttcatcttcccg

SEQ ID NO: 566832 - DNA, 497 bp, Homo sapiens; identical to SEQ ID NO: 535664
  misc_feature: HIJSMM301B27XT.22.14.B03.1.454.light.4.raw

SEQ ID NO: 566833 - DNA, 491 bp, Homo sapiens; identical to SEQ ID NO: 547784
  misc_feature: HIJSMM301CU1GZ.8.53.E09.1.454.light.4.raw

SEQ ID NO: 566834 - DNA, 484 bp, Homo sapiens; identical to SEQ ID NO: 553263
  misc_feature: HIJSMM301CRLLU.46.26.C04.1.454.light.4.raw
  modified_base (445)..(445): a, c, t, g, unknown or other

SEQ ID NO: 566835 - DNA, 466 bp, Homo sapiens; identical to SEQ ID NO: 536398
  misc_feature: HIJSMM301CGBL6.3.20.B09.1.454.light.4.raw

SEQ ID NO: 566836 - DNA, 512 bp, Homo sapiens
  misc_feature: HIJSMM301CMYB9.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcgaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 566837 - DNA, 499 bp, Homo sapiens; identical to SEQ ID NO: 543360
  misc_feature: HIJSMM301BLVHD.19.78.H01.1.454.light.4.raw

SEQ ID NO: 566838 - DNA, 492 bp, Homo sapiens; identical to SEQ ID NO: 536010
  misc_feature: HIJSMM301E0B9X.10.20.B09.1.454.light.4.raw

SEQ ID NO: 566839 - DNA, 489 bp, Homo sapiens; identical to SEQ ID NO: 536663
  misc_feature: HIJSMM301D28AG.16.72.G06.1.454.light.4.raw

SEQ ID NO: 566840 - DNA, 476 bp, Homo sapiens
  misc_feature: HIJSMM301CJ028.52.26.C04.1.454.light.4.raw
cgcagtacgacacgaccggtgctcgatttagtctagcgactttgggtttggggggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattgggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaaggct

SEQ ID NO: 566841 - DNA, 481 bp, Homo sapiens
  misc_feature: HIJSMM301ARWZ3.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtggagatcaaacgaactagtggctgcacc

SEQ ID NO: 566842 - DNA, 502 bp, Homo sapiens
  misc_feature: HIJSMM301CN5LM.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggcctgccccctcggtc

SEQ ID NO: 566843 - DNA, 470 bp, Homo sapiens
  misc_feature: HIJSMM301CXVOL.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaacttactactgtcaacagagtttcagtatcccttggactttcggtcaaggaccaaggtgaaatcaacgaa

SEQ ID NO: 566844 - DNA, 483 bp, Homo sapiens
  misc_feature: HIJSMM301DP86Q.49.84.H07.1.454.light.4.raw
agtcgagagacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccat

SEQ ID NO: 566845 - DNA, 513 bp, Homo sapiens
  misc_feature: HIJSMM301B6CN3.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccct

SEQ ID NO: 566846 - DNA, 485 bp, Homo sapiens
  misc_feature: HIJSMM301ANDUD.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaaggtaggaatacaacgaactagtggctgcaccta

SEQ ID NO: 566847 - DNA, 494 bp, Homo sapiens; identical to SEQ ID NO: 535276
  misc_feature: HIJSMM301AL9B2.16.6.A06.1.454.light.4.raw

SEQ ID NO: 566848 - DNA, 497 bp, Homo sapiens; identical to SEQ ID NO: 536371
  misc_feature: HIJSMM301BXQUD.16.78.H01.1.454.light.4.raw

SEQ ID NO: 566849 - DNA, 499 bp, Homo sapiens
  misc_feature: HIJSMM301DQ61L.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccaagggtgaccgtcctaggtcagcccaaggcc

SEQ ID NO: 566850 - DNA, 510 bp, Homo sapiens; identical to SEQ ID NO: 537801
  misc_feature: HIJSMM301AFEMF.5.60.F05.1.454.light.4.raw

SEQ ID NO: 566851 - DNA, 509 bp, Homo sapiens
  misc_feature: HIJSMM301BUKL9.51.86.H09.1.454.light.4.raw
cgatcgtatacacgaccggtgctcgatttagtgctatagacttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcta

SEQ ID NO: 566852 - DNA, 486 bp, Homo sapiens
  misc_feature: HIJSMM301A6ILB.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcacatcagcagtctgcaacctgaagattttgcaacttactactgtcaacagagttacggtaccccgtacacttttggccaggggaccaaactggacatcaaacgaactgtggctgcaccatctgt

SEQ ID NO: 566853 - DNA, 441 bp, Homo sapiens; identical to SEQ ID NO: 535074
  misc_feature: HIJSMM301A7XUV.11.3.A03.1.454.light.4.raw

SEQ ID NO: 566854 - DNA, 488 bp, Homo sapiens; identical to SEQ ID NO: 541987
  misc_feature: HIJSMM301DIV2I.8.12.B01.1.454.light.4.raw

SEQ ID NO: 566855 - DNA, 510 bp, Homo sapiens
  misc_feature: HIJSMM301CJH42.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccggggccactttcggccctcgggaccaaagtggatatcaaacgaactagtggctgcaccatctgtcttcta

SEQ ID NO: 566856 - DNA, 496 bp, Homo sapiens
  misc_feature: HIJSMM301AOARS.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctcgccccctcggtcactc

SEQ ID NO: 566857 - DNA, 445 bp, Homo sapiens; identical to SEQ ID NO: 535913
  misc_feature: HIJSMM301DQFVC.5.9.A09.1.454.light.4.raw

SEQ ID NO: 566858 - DNA, 486 bp, Homo sapiens; identical to SEQ ID NO: 535043
  misc_feature: HIJSMM301DYLAL.46.35.D02.1.454.light.4.raw

SEQ ID NO: 566859 - DNA, 510 bp, Homo sapiens; identical to SEQ ID NO: 537801
  misc_feature: HIJSMM301AOQKU.5.60.F05.1.454.light.4.raw

SEQ ID NO: 566860 - DNA, 525 bp, Homo sapiens
  misc_feature: HIJSMM301AI42G.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaaccgaacggtaggaagtacgaaaccgaactacgtggcgtggcaccactctgtcttctactcttcccgtccctact

SEQ ID NO: 566861 - DNA, 509 bp, Homo sapiens
  misc_feature: HIJSMM301A5T7E.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaacccactgtcactctgttccca

SEQ ID NO: 566862 - DNA, 488 bp, Homo sapiens
  misc_feature: HIJSMM301ENRZF.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggaccaaagtggatatacaaacgaactgtggctgcaccatctgtt

SEQ ID NO: 566863 - DNA, 506 bp, Homo sapiens; identical to SEQ ID NO: 543993
  misc_feature: HIJSMM301AQAV0.18.78.H01.1.454.light.4.raw

SEQ ID NO: 566864 - DNA, 494 bp, Homo sapiens
  misc_feature: HIJSMM301EKQ1A.47.64.F09.1.454.light.4.raw
agctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaagagccacccctctcctgcagggccagtcagaatattcactcctacttagcctggtaccaacagaaacctggtcaggctcccaggctcctcatctatgatgcactccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcacatctgtctcatt

SEQ ID NO: 566865 - DNA, 491 bp, Homo sapiens; identical to SEQ ID NO: 536211
  misc_feature: HIJSMM301AQM13.16.53.E09.1.454.light.4.raw

SEQ ID NO: 566866 - DNA, 481 bp, Homo sapiens; identical to SEQ ID NO: 535993
  misc_feature: HIJSMM301DH68Y.21.25.C03.1.454.light.4.raw

SEQ ID NO: 566867 - DNA, 488 bp, Homo sapiens; identical to SEQ ID NO: 537673
  misc_feature: HIJSMM301B4HMD.12.31.C09.1.454.light.4.raw

SEQ ID NO: 566868 - DNA, 354 bp, Homo sapiens; identical to SEQ ID NO: 535026
  misc_feature: HIJSMM301EMSN7.19.22.B11.1.454.light.4.raw

SEQ ID NO: 566869 - DNA, 449 bp, Homo sapiens
  misc_feature: HIJSMM301BKZED.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactgggtaccagcagcttccagggacagcccccaaacctcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 566870 - DNA, 489 bp, Homo sapiens; identical to SEQ ID NO: 535139
  misc_feature: HIJSMM301AIJFZ.14.55.E11.1.454.light.4.raw

SEQ ID NO: 566871 - DNA, 498 bp, Homo sapiens
  misc_feature: HIJSMM301ATXEI.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctcc

SEQ ID NO: 566872 - DNA, 492 bp, Homo sapiens
  misc_feature: HIJSMM301AJ5YS.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccctccggtccactctcgttcccgccctcctcga

SEQ ID NO: 566873 - DNA, 491 bp, Homo sapiens
  misc_feature: HIJSMM301CCTWW.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagtattttacactagaaaatcagtagagtggaggctggaggatgttggtagtttattactgcatgcaagctctacaaactcctctcactttcggcggacgggaccaaggtggagatacaaacgaact

SEQ ID NO: 566874 - DNA, 484 bp, Homo sapiens; identical to SEQ ID NO: 535400
  misc_feature: HIJSMM301DDPU2.46.26.C04.1.454.light.4.raw

SEQ ID NO: 566875 - DNA, 497 bp, Homo sapiens
  misc_feature: HIJSMM301CLVXX.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtcaccgtcctgggtcagcccaaggccaacccactgtcact

SEQ ID NO: 566876 - DNA, 499 bp, Homo sapiens
  misc_feature: HIJSMM301ED2J7.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttatactgtcagcagcgtagcaactggcctcggttcacttttggccaggggaccaagctggagatcaaacgaactgtggctgcaccatctgtcttcatt

SEQ ID NO: 566877 - DNA, 515 bp, Homo sapiens; identical to SEQ ID NO: 538805
  misc_feature: HIJSMM301EX39Q.14.19.B08.1.454.light.4.raw

SEQ ID NO: 566878 - DNA, 495 bp, Homo sapiens; identical to SEQ ID NO: 538651
  misc_feature: HIJSMM301EVZBF.10.79.H02.1.454.light.4.raw

SEQ ID NO: 566879 - DNA, 484 bp, Homo sapiens
  misc_feature: HIJSMM301AKTTL.49.53.E09.1.454.light.4.raw
agtcgagagacacgaccggtgctcgatttagagagagtgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacg

SEQ ID NO: 566880 - DNA, 479 bp, Homo sapiens
  misc_feature: HIJSMM301DCLER.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatcgtgggacagatttttactttcaccatcagcagcctgcagcctgaagatattgcaacatattactgtcagcagtatgataatctccgatcaccttcggccaagggacacgactggagaattaaacgaactgtggctgcaccta

SEQ ID NO: 566881 - DNA, 493 bp, Homo sapiens; identical to SEQ ID NO: 538753
  misc_feature: HIJSMM301ENB9G.27.78.H01.1.454.light.4.raw

SEQ ID NO: 566882 - DNA, 506 bp, Homo sapiens
  misc_feature: HIJSMM301ESJ8E.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccgggcccagattgaggatgaggctgactattattgttactctgcggctgacaacatcttggtttcggcgggggactagtgaccgtcggtggtcacgccaagctcgcccctcggtcactctcgttcccgccctcctctacgttacg

SEQ ID NO: 566883 - DNA, 521 bp, Homo sapiens; identical to SEQ ID NO: 545914
  misc_feature: HIJSMM301DBFPZ.40.46.E02.1.454.light.4.raw

SEQ ID NO: 566884 - DNA, 447 bp, Homo sapiens; identical to SEQ ID NO: 535201
  misc_feature: HIJSMM301C8XX0.18.9.A09.1.454.light.4.raw

SEQ ID NO: 566885 - DNA, 494 bp, Homo sapiens; identical to SEQ ID NO: 534994
  misc_feature: HIJSMM301ALSS9.27.78.H01.1.454.light.4.raw

SEQ ID NO: 566886 - DNA, 490 bp, Homo sapiens
  misc_feature: HIJSMM301E2NO7.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacactttggtccagggaccgaaactaggacatcaaacgaactagtggctgcaccatctgtt

SEQ ID NO: 566887 - DNA, 505 bp, Homo sapiens
  misc_feature: HIJSMM301BQB4R.3.37.D04.1.454.light.4.raw
agacgcactccacgaccggtgctcgatttagtagcatactgttgggtttggggggggtcgtcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctc

SEQ ID NO: 566888 - DNA, 484 bp, Homo sapiens; identical to SEQ ID NO: 535441
  misc_feature: HIJSMM301APM7L.26.60.F05.1.454.light.4.raw

SEQ ID NO: 566889 - DNA, 472 bp, Homo sapiens
  misc_feature: HIJSMM301ALP01.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtgggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 566890 - DNA, 512 bp, Homo sapiens; identical to SEQ ID NO: 539813
  misc_feature: HIJSMM301EV2HY.14.7.A07.1.454.light.4.raw

SEQ ID NO: 566891 - DNA, 521 bp, Homo sapiens
  misc_feature: HIJSMM301B43AI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccggcaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 566892 - DNA, 498 bp, Homo sapiens
  misc_feature: HIJSMM301D7IS8.40.57.F02.1.454.light.4.raw
tctagcgactcacgaccggtgctcgatttagctcgatatagttgggtttggggggggctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaaggctcg

SEQ ID NO: 566893 - DNA, 494 bp, Homo sapiens; identical to SEQ ID NO: 535276
  misc_feature: HIJSMM301BEBH3.16.6.A06.1.454.light.4.raw

SEQ ID NO: 566894 - DNA, 483 bp, Homo sapiens
  misc_feature: HIJSMM301CIZSR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggcagggaccaagctggagatcaaacgaactgtggctgcaccat

SEQ ID NO: 566895 - DNA, 507 bp, Homo sapiens; identical to SEQ ID NO: 541461
  misc_feature: HIJSMM301DIK3J.11.57.F02.1.454.light.4.raw

SEQ ID NO: 566896 - DNA, 504 bp, Homo sapiens
  misc_feature: HIJSMM301BB4N4.8.28.C06.1.454.light.4.raw
  modified_base (495)..(495): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcntcttccgcc

SEQ ID NO: 566897 - DNA, 477 bp, Homo sapiens
  misc_feature: HIJSMM301ATW3Q.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccaaatatgttcagtggctgcgggtcaggcacagatctcacactgaaaaacagccgggtggagagtgaccatgttggaacttattactgcatgcaaga

SEQ ID NO: 566898 - DNA, 489 bp, Homo sapiens; identical to SEQ ID NO: 535386
  misc_feature: HIJSMM301EOF2X.12.51.E07.1.454.light.4.raw

SEQ ID NO: 566899 - DNA, 486 bp, Homo sapiens; identical to SEQ ID NO: 535043
  misc_feature: HIJSMM301DUY9U.46.35.D02.1.454.light.4.raw

SEQ ID NO: 566900 - DNA, 471 bp, Homo sapiens; identical to SEQ ID NO: 548341
  misc_feature: HIJSMM301B1JBK.13.48.E04.1.454.light.4.raw

SEQ ID NO: 566901 - DNA, 497 bp, Homo sapiens; identical to SEQ ID NO: 536376
  misc_feature: HIJSMM301D67IA.22.9.A09.1.454.light.4.raw

SEQ ID NO: 566902 - DNA, 494 bp, Homo sapiens; identical to SEQ ID NO: 535629
  misc_feature: HIJSMM301CZOSZ.4.27.C05.1.454.light.4.raw

SEQ ID NO: 566903 - DNA, 501 bp, Homo sapiens
  misc_feature: HIJSMM301CEIVD.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctggtccactctgttcccaccctcctcgctacgtaga

SEQ ID NO: 566904 - DNA, 485 bp, Homo sapiens
  misc_feature: HIJSMM301CU5QC.49.81.H04.1.454.light.4.raw
agtcgagagacacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattaactgtcaacaatatgataatctaccactcactttcgtcggagggaccacggtggaggatcaaacgaactagtggctgcaccat

SEQ ID NO: 566905 - DNA, 499 bp, Homo sapiens; identical to SEQ ID NO: 547044
  misc_feature: HIJSMM301DNWE4.43.71.G05.1.454.light.4.raw

SEQ ID NO: 566906 - DNA, 484 bp, Homo sapiens
  misc_feature: HIJSMM301AN38S.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtggctgcacc

SEQ ID NO: 566907 - DNA, 493 bp, Homo sapiens
  misc_feature: HIJSMM301ESJ6U.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcacgtcctaggtcagcccaaggccaacccc

SEQ ID NO: 566908 - DNA, 424 bp, Homo sapiens
  misc_feature: HIJSMM301BCHMP.41.47.E03.1.454.light.4.raw
tctatactatcacgaccggtgctcgatttagactcgcgcacagagagaagggcacgaccggtgctcgatttagtacgctgtctttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttccgccatctgaatagtataga

SEQ ID NO: 566909 - DNA, 486 bp, Homo sapiens; identical to SEQ ID NO: 541357
  misc_feature: HIJSMM301ECKX3.17.26.C04.1.454.light.4.raw

SEQ ID NO: 566910 - DNA, 484 bp, Homo sapiens
  misc_feature: HIJSMM301DBSH1.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggaggcaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 566911 - DNA, 455 bp, Homo sapiens; identical to SEQ ID NO: 552052
  misc_feature: HIJSMM301BXRBB.19.86.H09.1.454.light.4.raw

SEQ ID NO: 566912 - DNA, 495 bp, Homo sapiens; identical to SEQ ID NO: 535821
  misc_feature: HIJSMM301CT54B.3.31.C09.1.454.light.4.raw

SEQ ID NO: 566913 - DNA, 493 bp, Homo sapiens
  misc_feature: HIJSMM301A7PHB.43.37.D04.1.454.light.4.raw
tgtgagtagtcacgaccggtgctcgatttagtagcatactgttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccgaaggtaggaaatcaaacgaactgtggctgcaccatct

SEQ ID NO: 566914 - DNA, 492 bp, Homo sapiens
  misc_feature: HIJSMM301CABDK.49.67.G01.1.454.light.4.raw
agtcgagagacacgaccggtgctcgatttagagtatacatattggggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaatcagacgaactgtggctgcaccat

SEQ ID NO: 566915 - DNA, 494 bp, Homo sapiens; identical to SEQ ID NO: 534992
  misc_feature: HIJSMM301ATAWA.9.1.A01.1.454.light.4.raw

SEQ ID NO: 566916 - DNA, 507 bp, Homo sapiens
  misc_feature: HIJSMM301D482C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccgaaggtaggaaatcaaacgaactacgtggctgcgaccatctgtcttcattcttccccg

SEQ ID NO: 566917 - DNA, 494 bp, Homo sapiens; identical to SEQ ID NO: 549057
  misc_feature: HIJSMM301AWX2H.10.33.C11.1.454.light.4.raw

SEQ ID NO: 566918 - DNA, 494 bp, Homo sapiens
  misc_feature: HIJSMM301BKJLO.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggaggagtcaaacgaacta

SEQ ID NO: 566919 - DNA, 447 bp, Homo sapiens; identical to SEQ ID NO: 535020
  misc_feature: HIJSMM301DBSHJ.18.9.A09.1.454.light.4.raw

SEQ ID NO: 566920 - DNA, 503 bp, Homo sapiens; identical to SEQ ID NO: 536834
  misc_feature: HIJSMM301ECTKG.2.35.D02.1.454.light.4.raw

SEQ ID NO: 566921 - DNA, 497 bp, Homo sapiens; identical to SEQ ID NO: 535664
  misc_feature: HIJSMM301DPTI2.22.14.B03.1.454.light.4.raw

SEQ ID NO: 566922 - DNA, 509 bp, Homo sapiens; identical to SEQ ID NO: 539359
  misc_feature: HIJSMM301A2HYE.47.85.H08.1.454.light.4.raw

SEQ ID NO: 566923 - DNA, 504 bp, Homo sapiens
  misc_feature: HIJSMM301BTMAS.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactagtggctgcaccatctgtt

SEQ ID NO: 566924 - DNA, 508 bp, Homo sapiens
  misc_feature: HIJSMM301BBTBZ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaacggaccaaccccaacctgtcta

SEQ ID NO: 566925 - DNA, 486 bp, Homo sapiens; identical to SEQ ID NO: 535043
  misc_feature: HIJSMM301DG8TJ.46.35.D02.1.454.light.4.raw

SEQ ID NO: 566926 - DNA, 483 bp, Homo sapiens
  misc_feature: HIJSMM301BXFEH.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttgcggtacccgtacacttttggccaggggaccaaactggacatcaaacgaactgtcggctgcaccat

SEQ ID NO: 566927 - DNA, 513 bp, Homo sapiens
  misc_feature: HIJSMM301EVND1.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccagggaccgaccacgtagaaatagagacggaactagtggtctgcgaccaactcttgtcttctactcttcccgt

SEQ ID NO: 566928 - DNA, 495 bp, Homo sapiens
  misc_feature: HIJSMM301ALQP4.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtcttcttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaatacaaacgaactagtggctgcaccatctgtcttcat

SEQ ID NO: 566929 - DNA, 499 bp, Homo sapiens; identical to SEQ ID NO: 536875
  misc_feature: HIJSMM301C48B2.51.26.C04.1.454.light.4.raw

SEQ ID NO: 566930 - DNA, 490 bp, Homo sapiens
  misc_feature: HIJSMM301DWHSC.48.33.C11.1.454.light.4.raw
agtatacatacacgaccggtgctcgatttagagtgagctcgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccggcagaagacgaggctgactactattgtcagtcaggagacaatactcgcacgcaagtactgttcggcggagggaccaagctgacagtcctaggtcagcccaaggctgcccccg

SEQ ID NO: 566931 - DNA, 484 bp, Homo sapiens; identical to SEQ ID NO: 535240
  misc_feature: HIJSMM301AP2SG.47.60.F05.1.454.light.4.raw

SEQ ID NO: 566932 - DNA, 446 bp, Homo sapiens; identical to SEQ ID NO: 557437
  misc_feature: HIJSMM301CZ4P5.5.9.A09.1.454.light.4.raw

SEQ ID NO: 566933 - DNA, 518 bp, Homo sapiens
  misc_feature: HIJSMM301AH3XE.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaacggtggagggtcgaaacgaaccgtagtggcgtgcgaccatctgtctt

SEQ ID NO: 566934 - DNA, 496 bp, Homo sapiens; identical to SEQ ID NO: 551939
  misc_feature: HIJSMM301CFLZ0.19.71.G05.1.454.light.4.raw

SEQ ID NO: 566935 - DNA, 510 bp, Homo sapiens
  misc_feature: HIJSMM301ES46H.17.33.C11.1.454.light.4.raw
cgtagactagcacgaccggtgctcgatttagagtgagctcgttgggtttggggtctggcgtccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 566936 - DNA, 486 bp, Homo sapiens; identical to SEQ ID NO: 536323
  misc_feature: HIJSMM301EZFEG.10.2.A02.1.454.light.4.raw

SEQ ID NO: 566937 - DNA, 487 bp, Homo sapiens
  misc_feature: HIJSMM301B1WF0.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacgaccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccca

SEQ ID NO: 566938 - DNA, 497 bp, Homo sapiens; identical to SEQ ID NO: 535740
  misc_feature: HIJSMM301B3D1I.3.71.G05.1.454.light.4.raw

SEQ ID NO: 566939 - DNA, 502 bp, Homo sapiens
  misc_feature: HIJSMM301CR6DJ.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 566940 - DNA, 467 bp, Homo sapiens; identical to SEQ ID NO: 541349
  misc_feature: HIJSMM301A5TLC.4.75.G09.1.454.light.4.raw

SEQ ID NO: 566941 - DNA, 469 bp, Homo sapiens
  misc_feature: HIJSMM301CDFDP.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcacttttcggcgggggaccgaaggtggagatcaagcgaact

SEQ ID NO: 566942 - DNA, 512 bp, Homo sapiens
  misc_feature: HIJSMM301C849L.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaatacaaacgaactacgtggctgcaccatctgtctt

SEQ ID NO: 566943 - DNA, 502 bp, Homo sapiens
  misc_feature: HIJSMM301BHFT8.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactcctgttcccgccctcctcgttatctctcg

SEQ ID NO: 566944 - DNA, 487 bp, Homo sapiens; identical to SEQ ID NO: 545757
  misc_feature: HIJSMM301EY5OQ.49.3.A03.1.454.light.4.raw

SEQ ID NO: 566945 - DNA, 503 bp, Homo sapiens
  misc_feature: HIJSMM301A8W9U.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccagcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 566946 - DNA, 515 bp, Homo sapiens
  misc_feature: HIJSMM301CDI5Y.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctcgttcccaccct

SEQ ID NO: 566947 - DNA, 488 bp, Homo sapiens; identical to SEQ ID NO: 535861
  misc_feature: HIJSMM301D5S2I.14.55.E11.1.454.light.4.raw

SEQ ID NO: 566948 - DNA, 506 bp, Homo sapiens; identical to SEQ ID NO: 539926
  misc_feature: HIJSMM301AZBUK.5.24.C02.1.454.light.4.raw

SEQ ID NO: 566949 - DNA, 479 bp, Homo sapiens
  misc_feature: HIJSMM301C1BQG.11.17.B06.1.454.light.4.raw
cgagagataccacgaccggtgctcgatttagtcgatagtgaagggggcaggagtcagtctcagtcaggacactgcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtggctgcaa

SEQ ID NO: 566950 - DNA, 468 bp, Homo sapiens
  misc_feature: HIJSMM301CMVEV.49.79.H02.1.454.light.4.raw
agtcgagagacacgaccggtgctcgatttagtgtcacacgaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcggggggaccaaggtggagatcaagcgaa

SEQ ID NO: 566951 - DNA, 496 bp, Homo sapiens; identical to SEQ ID NO: 535109
  misc_feature: HIJSMM301CXIWJ.16.78.H01.1.454.light.4.raw

SEQ ID NO: 566952 - DNA, 502 bp, Homo sapiens
  misc_feature: HIJSMM301BLRMC.18.11.A11.1.454.light.4.raw
tacgagtatgcacgaccggtgctcgatttagctacgactgcagggggagctacaacgaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 566953 - DNA, 505 bp, Homo sapiens
  misc_feature: HIJSMM301DH5CJ.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccgccctccc

SEQ ID NO: 566954 - DNA, 473 bp, Homo sapiens
  misc_feature: HIJSMM301AFD5A.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 566955 - DNA, 497 bp, Homo sapiens; identical to SEQ ID NO: 535740
  misc_feature: HIJSMM301DNVMA.3.71.G05.1.454.light.4.raw

SEQ ID NO: 566956 - DNA, 523 bp, Homo sapiens
  misc_feature: HIJSMM301EQN3N.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaacggccaaccccacctgtcactctgttcccaccctcctccgtcgtc

SEQ ID NO: 566957 - DNA, 486 bp, Homo sapiens; identical to SEQ ID NO: 535043
  misc_feature: HIJSMM301DFBLF.46.35.D02.1.454.light.4.raw

SEQ ID NO: 566958 - DNA, 496 bp, Homo sapiens; identical to SEQ ID NO: 535109
  misc_feature: HIJSMM301ASL0L.16.78.H01.1.454.light.4.raw

SEQ ID NO: 566959 - DNA, 509 bp, Homo sapiens
  misc_feature: HIJSMM301EJB3P.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgcct

SEQ ID NO: 566960 - DNA, 493 bp, Homo sapiens; identical to SEQ ID NO: 543580
  misc_feature: HIJSMM301CGJPV.51.71.G05.1.454.light.4.raw

SEQ ID NO: 566961 - DNA, 447 bp, Homo sapiens; identical to SEQ ID NO: 535201
  misc_feature: HIJSMM301C5X49.18.9.A09.1.454.light.4.raw

SEQ ID NO: 566962 - DNA, 502 bp, Homo sapiens; identical to SEQ ID NO: 541384
  misc_feature: HIJSMM301BV2HR.14.57.F02.1.454.light.4.raw

SEQ ID NO: 566963 - DNA, 447 bp, Homo sapiens; identical to SEQ ID NO: 535020
  misc_feature: HIJSMM301CPY7N.18.9.A09.1.454.light.4.raw

SEQ ID NO: 566964 - DNA, 499 bp, Homo sapiens; identical to SEQ ID NO: 539172
  misc_feature: HIJSMM301C0KCI.48.36.D03.1.454.light.4.raw

SEQ ID NO: 566965 - DNA, 483 bp, Homo sapiens
  misc_feature: HIJSMM301DHCN7.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcacatctgtcttcatcttcccgccatctgactagtctacg

SEQ ID NO: 566966 - DNA, 509 bp, Homo sapiens
  misc_feature: HIJSMM301CSRKJ.15.59.F04.1.454.light.4.raw
  modified_base (437)..(437): a, c, t, g, unknown or other
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtnctggcattttcggtcttcggcggagggaccaagctgaccgtcctaggtcagcccaaggctcgccccctcggt

SEQ ID NO: 566967 - DNA, 497 bp, Homo sapiens; identical to SEQ ID NO: 558011
  misc_feature: HIJSMM301BG5C6.51.83.H06.1.454.light.4.raw

SEQ ID NO: 566968 - DNA, 489 bp, Homo sapiens; identical to SEQ ID NO: 535139
  misc_feature: HIJSMM301AJMH3.14.55.E11.1.454.light.4.raw

SEQ ID NO: 566969 - DNA, 515 bp, Homo sapiens
  misc_feature: HIJSMM301AJMIA.49.28.C06.1.454.light.4.raw
agtcgagagacacgaccggtgctcgatttagagctcacgtattgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcg

SEQ ID NO: 566970 - DNA, 489 bp, Homo sapiens; identical to SEQ ID NO: 535139
  misc_feature: HIJSMM301CVZ2E.14.55.E11.1.454.light.4.raw

SEQ ID NO: 566971 - DNA, 494 bp, Homo sapiens
  misc_feature: HIJSMM301B8YK9.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggtccgacgggaccggaaaggtacgaaagtagagacggaactagttggcgtgcaccat

SEQ ID NO: 566972 - DNA, 486 bp, Homo sapiens; identical to SEQ ID NO: 535043
  misc_feature: HIJSMM301DGUDX.46.35.D02.1.454.light.4.raw

SEQ ID NO: 566973 - DNA, 496 bp, Homo sapiens
  misc_feature: HIJSMM301EUAJK.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgttcgaagacgaactagtggcgtgcaccatcttcg

SEQ ID NO: 566974 - DNA, 517 bp, Homo sapiens; identical to SEQ ID NO: 539798
  misc_feature: HIJSMM301BDSZ7.14.70.G04.1.454.light.4.raw

SEQ ID NO: 566975 - DNA, 511 bp, Homo sapiens
  misc_feature: HIJSMM301A1YHH.5.58.F03.1.454.light.4.raw
  modified_base (446)..(446): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttangttcgggactgggaccaaggtcaccgtcctaggtcagcccaaggccaaccccactgtcactctcg

SEQ ID NO: 566976 - DNA, 505 bp, Homo sapiens; identical to SEQ ID NO: 539292
  misc_feature: HIJSMM301CG270.19.85.H08.1.454.light.4.raw

SEQ ID NO: 566977 - DNA, 485 bp, Homo sapiens; identical to SEQ ID NO: 535606
  misc_feature: HIJSMM301AEKHF.47.46.E02.1.454.light.4.raw

SEQ ID NO: 566978 - DNA, 513 bp, Homo sapiens
  misc_feature: HIJSMM301AQLW6.49.47.E03.1.454.light.4.raw
agtcgagagacacgaccggtgctcgatttagactcgcgcacagagagaggggcgtgggcctaaggaagcagcactggtggtgcctcagccatggcctggaccgttctcctcctcggcctcctctctcactgcacaggctctgtgacctcctatgtgctgactcagacaccctcggtgtcggtggcccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactggaccaaagtcaccgtcctaggtcagcccaaggccaaccccacctgtcactctgttcccaccctt

SEQ ID NO: 566979 - DNA, 504 bp, Homo sapiens
  misc_feature: HIJSMM301BV51W.22.21.B10.1.454.light.4.raw
  modified_base (447)..(447): a, c, t, g, unknown or other
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggnggagggaccaagctgaccgtcctaggtcagcccaaggctgccccctggtcactctcg

SEQ ID NO: 566980 - DNA, 483 bp, Homo sapiens
  misc_feature: HIJSMM301BJGF7.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccagggtggaaatacaaacgaactagtggctgcaccat

SEQ ID NO: 566981 - DNA, 504 bp, Homo sapiens
  misc_feature: HIJSMM301AK6W7.48.34.D01.1.454.light.4.raw
agtatacatacacgaccggtgctcgatttagatcgtctgtgttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatacgaactgtggctgcaccatctgtcttcatt

SEQ ID NO: 566982 - DNA, 508 bp, Homo sapiens; identical to SEQ ID NO: 536388
  misc_feature: HIJSMM301AKW5D.11.57.F02.1.454.light.4.raw

SEQ ID NO: 566983 - DNA, 497 bp, Homo sapiens; identical to SEQ ID NO: 536371
  misc_feature: HIJSMM301BQ43A.16.78.H01.1.454.light.4.raw

SEQ ID NO: 566984 - DNA, 445 bp, Homo sapiens; identical to SEQ ID NO: 537719
  misc_feature: HIJSMM301EDKEK.47.85.H08.1.454.light.4.raw

SEQ ID NO: 566985 - DNA, 444 bp, Homo sapiens; identical to SEQ ID NO: 535411
  misc_feature: HIJSMM301DU68J.8.73.G07.1.454.light.4.raw

SEQ ID NO: 566986 - DNA, 472 bp, Homo sapiens
  misc_feature: HIJSMM301CU078.15.12.B01.1.454.light.4.raw
  modified_base (454)..(454): a, c, t, g, unknown or other
tctacgtagccacgaccggtgctcgatttagtagtgtagattcggcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcacccaaattcatgatttatgaggtaactaatcggccctcagggtttctaatcgcttctctggctccaagtctggcaacacggcctccctgaccatctctgggctccaggctgaggacgaggctgattattattgcatctcatatacaaaccaacagcactctcgactggtattcggcggagggaccaagctgacgtcctaggtcagcccaaggctgccccctcggtcactctgttcccnccctcctcgctacgtaga

SEQ ID NO: 566987 - DNA, 498 bp, Homo sapiens; identical to SEQ ID NO: 550538
  misc_feature: HIJSMM301C9H1E.52.29.C07.1.454.light.4.raw

SEQ ID NO: 566988 - DNA, 487 bp, Homo sapiens; identical to SEQ ID NO: 539157
  misc_feature: HIJSMM301CT3KA.26.37.D04.1.454.light.4.raw

SEQ ID NO: 566989 - DNA, 494 bp, Homo sapiens
  misc_feature: HIJSMM301DZNFH.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctcgtcctacttttggccgagggggacccaagctggagatcaggcgtaacg

SEQ ID NO: 566990 - DNA, 482 bp, Homo sapiens
  misc_feature: HIJSMM301EA37B.51.76.G10.1.454.light.4.raw
cgatcgtatacacgaccggtgctcgatttagtcactcatacaggggagagctctggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgt

SEQ ID NO: 566991 - DNA, 505 bp, Homo sapiens
  misc_feature: HIJSMM301A4TGV.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggaggagggaccaaactgaccgtcctaggtcagcccaaggcctgccccctcggtcactctgtt

SEQ ID NO: 566992 - DNA, 496 bp, Homo sapiens
  misc_feature: HIJSMM301EQLYH.49.68.G02.1.454.light.4.raw
agtcgagagacacgaccggtgctcgatttagtcgatagtgaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 566993 - DNA, 496 bp, Homo sapiens; identical to SEQ ID NO: 540207
  misc_feature: HIJSMM301DX7M8.40.57.F02.1.454.light.4.raw

SEQ ID NO: 566994 - DNA, 498 bp, Homo sapiens
  misc_feature: HIJSMM301BSRK7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgtaggctgaagatgtggcagtttattattgtcaacaatattattatacttcgtggacgttcggtccaagggaccaaggtggatatcagacgaactgtggctgca

SEQ ID NO: 566995 - DNA, 488 bp, Homo sapiens; identical to SEQ ID NO: 542120
  misc_feature: HIJSMM301CNUUN.47.38.D05.1.454.light.4.raw

SEQ ID NO: 566996 - DNA, 508 bp, Homo sapiens; identical to SEQ ID NO: 536388
  misc_feature: HIJSMM301BWET0.11.57.F02.1.454.light.4.raw

SEQ ID NO: 566997 - DNA, 491 bp, Homo sapiens
  misc_feature: HIJSMM301B1Y71.51.15.B04.1.454.light.4.raw
cgatcgtatacacgaccggtgctcgatttagacagtatatatccgcggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctccatagtaatggattcagctatttggattggtacctgcagaggccagggcagtctccacagctcctgatctatttgggttctaatcgggccccgggtccctgacaggttcagtggcagtggatcaggcacagattttacactgaaaatcagcagcgtggaggctgaggatgttggggtttattactgcatgcaagctctacaaactcctacgttcggccaagggaccaaggtggaaatcaaacgaactgtggctgcaccta

SEQ ID NO: 566998 - DNA, 513 bp, Homo sapiens
  misc_feature: HIJSMM301C06WZ.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctggtcactctgttcccgccct

SEQ ID NO: 566999 - DNA, 503 bp, Homo sapiens; identical to SEQ ID NO: 551625
  misc_feature: HIJSMM301EE1R3.10.71.G05.1.454.light.4.raw

SEQ ID NO: 567000 - DNA, 494 bp, Homo sapiens; identical to SEQ ID NO: 535680
  misc_feature: HIJSMM301ECQX3.16.78.H01.1.454.light.4.raw

SEQ ID NO: 567001 - DNA, 454 bp, Homo sapiens; identical to SEQ ID NO: 536449
  misc_feature: HIJSMM301A0Y6V.18.78.H01.1.454.light.4.raw

SEQ ID NO: 567002 - DNA, 521 bp, Homo sapiens
  misc_feature: HIJSMM301BSC6B.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccgaggaccgaacggtaggaagtacaagacgaacgtacgtggcgtgcgaccactctcgtcgttctactcttcccgttccccg

SEQ ID NO: 567003 - DNA, 444 bp, Homo sapiens; identical to SEQ ID NO: 536096
  misc_feature: HIJSMM301CAP6L.7.18.B07.1.454.light.4.raw

SEQ ID NO: 567004 - DNA, 490 bp, Homo sapiens; identical to SEQ ID NO: 535865
  misc_feature: HIJSMM301DRUI4.5.11.A11.1.454.light.4.raw

SEQ ID NO: 567005 - DNA, 503 bp, Homo sapiens; identical to SEQ ID NO: 565820
  misc_feature: HIJSMM301C1N25.18.59.F04.1.454.light.4.raw

SEQ ID NO: 567006 - DNA, 495 bp, Homo sapiens
  misc_feature: HIJSMM301A9Z0Q.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccggggggacgttcggccaagggaccaaggtggagatcaaacgaactgtggctgcaccatctgtcttcatt

SEQ ID NO: 567007 - DNA, 520 bp, Homo sapiens; identical to SEQ ID NO: 543171
  misc_feature: HIJSMM301DFY0H.48.24.C02.1.454.light.4.raw

SEQ ID NO: 567008 - DNA, 491 bp, Homo sapiens; identical to SEQ ID NO: 535176
  misc_feature: HIJSMM301APF22.13.39.D06.1.454.light.4.raw

SEQ ID NO: 567009 - DNA, 504 bp, Homo sapiens
  misc_feature: HIJSMM301ECFFO.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaaactgaccgtcctaggtcagcccaaggctgccccctcg

SEQ ID NO: 567010 - DNA, 444 bp, Homo sapiens; identical to SEQ ID NO: 535027
  misc_feature: HIJSMM301ARF8E.8.73.G07.1.454.light.4.raw

SEQ ID NO: 567011 - DNA, 519 bp, Homo sapiens; identical to SEQ ID NO: 560915
  misc_feature: HIJSMM301CHBH8.27.23.C01.1.454.light.4.raw

SEQ ID NO: 567012 - DNA, 486 bp, Homo sapiens; identical to SEQ ID NO: 535385
  misc_feature: HIJSMM301DYVPT.19.71.G05.1.454.light.4.raw

SEQ ID NO: 567013 - DNA, 471 bp, Homo sapiens; identical to SEQ ID NO: 536321
  misc_feature: HIJSMM301EMB1K.15.8.A08.1.454.light.4.raw

SEQ ID NO: 567014 - DNA, 504 bp, Homo sapiens; identical to SEQ ID NO: 538521
  misc_feature: HIJSMM301B558Z.9.12.B01.1.454.light.4.raw

SEQ ID NO: 567015 - DNA, 480 bp, Homo sapiens; identical to SEQ ID NO: 535975
  misc_feature: HIJSMM301APS4Z.51.60.F05.1.454.light.4.raw

SEQ ID NO: 567016 - DNA, 503 bp, Homo sapiens
  misc_feature: HIJSMM301AMM9M.14.23.C01.1.454.light.4.raw
cgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaagtacaaacgaactgtggcgtgcaccatctgtcttcta

SEQ ID NO: 567017 - DNA, 484 bp, Homo sapiens
  misc_feature: HIJSMM301EOHR0.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcaccatctgtcttca

SEQ ID NO: 567018 - DNA, 503 bp, Homo sapiens; identical to SEQ ID NO: 547049
  misc_feature: HIJSMM301CHVJ6.18.59.F04.1.454.light.4.raw

SEQ ID NO: 567019 - DNA, 485 bp, Homo sapiens; identical to SEQ ID NO: 535880
  misc_feature: HIJSMM301CSFWC.7.75.G09.1.454.light.4.raw

SEQ ID NO: 567020 - DNA, 504 bp, Homo sapiens; identical to SEQ ID NO: 554247
  misc_feature: HIJSMM301BGK6V.19.78.H01.1.454.light.4.raw

SEQ ID NO: 567021 - DNA, 513 bp, Homo sapiens; identical to SEQ ID NO: 551867
  misc_feature: HIJSMM301AK2JF.43.19.B08.1.454.light.4.raw

SEQ ID NO: 567022 - DNA, 493 bp, Homo sapiens; identical to SEQ ID NO: 536246
  misc_feature: HIJSMM301CE01O.49.66.F11.1.454.light.4.raw

SEQ ID NO: 567023 - DNA, 505 bp, Homo sapiens
  misc_feature: HIJSMM301AFNZX.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagccaaggctgccccctcggt

SEQ ID NO: 567024 - DNA, 518 bp, Homo sapiens; identical to SEQ ID NO: 535407
  misc_feature: HIJSMM301AHKYI.22.30.C08.1.454.light.4.raw

SEQ ID NO: 567025 - DNA, 483 bp, Homo sapiens
  misc_feature: HIJSMM301BDIY7.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccgaacgggaaccgaacggtagggtaaatacaaacgaaactacgt

SEQ ID NO: 567026 - DNA, 505 bp, Homo sapiens
  misc_feature: HIJSMM301D4VAN.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaacgaactgtggctgcaccatctgtcttcat

SEQ ID NO: 567027 - DNA, 511 bp, Homo sapiens
  misc_feature: HIJSMM301DL8AU.48.67.G01.1.454.light.4.raw
agtatacatacacgaccggtgctcgatttagagtatacatattgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 567028 - DNA, 503 bp, Homo sapiens; identical to SEQ ID NO: 559148
  misc_feature: HIJSMM301ED1SX.7.31.C09.1.454.light.4.raw

SEQ ID NO: 567029 - DNA, 447 bp, Homo sapiens
  misc_feature: HIJSMM301C4JRW.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactagtttgggtgtttgggtgttcggcggagggaccaagctgaccgtcctgagtcagcccaaggctcgccccctcggtcactctgttccccgccctcctccgtgtctgat

SEQ ID NO: 567030 - DNA, 501 bp, Homo sapiens; identical to SEQ ID NO: 536142
  misc_feature: HIJSMM301ETQCM.15.1.A01.1.454.light.4.raw

SEQ ID NO: 567031 - DNA, 488 bp, Homo sapiens; identical to SEQ ID NO: 539612
  misc_feature: HIJSMM301BCR31.3.55.E11.1.454.light.4.raw

SEQ ID NO: 567032 - DNA, 467 bp, Homo sapiens; identical to SEQ ID NO: 558396
  misc_feature: HIJSMM301CA8I9.3.20.B09.1.454.light.4.raw

SEQ ID NO: 567033 - DNA, 490 bp, Homo sapiens
  misc_feature: HIJSMM301BL57S.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcactggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 567034 - DNA, 490 bp, Homo sapiens; identical to SEQ ID NO: 535234
  misc_feature: HIJSMM301A49B3.17.21.B10.1.454.light.4.raw

SEQ ID NO: 567035 - DNA, 484 bp, Homo sapiens; identical to SEQ ID NO: 535211
  misc_feature: HIJSMM301DLPDX.47.46.E02.1.454.light.4.raw

SEQ ID NO: 567036 - DNA, 496 bp, Homo sapiens
  misc_feature: HIJSMM301CB7R8.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgt

SEQ ID NO: 567037 - DNA, 495 bp, Homo sapiens; identical to SEQ ID NO: 538920
  misc_feature: HIJSMM301D0KZC.47.64.F09.1.454.light.4.raw

SEQ ID NO: 567038 - DNA, 511 bp, Homo sapiens
  misc_feature: HIJSMM301CJICA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctgccccctcggtcactctcgttcccta

SEQ ID NO: 567039 - DNA, 485 bp, Homo sapiens; identical to SEQ ID NO: 551345
  misc_feature: HIJSMM301DOPQ2.40.83.H06.1.454.light.4.raw

SEQ ID NO: 567040 - DNA, 517 bp, Homo sapiens; identical to SEQ ID NO: 543501
  misc_feature: HIJSMM301AT4M9.47.53.E09.1.454.light.4.raw

SEQ ID NO: 567041 - DNA, 501 bp, Homo sapiens
  misc_feature: HIJSMM301CZZOA.48.70.G04.1.454.light.4.raw
agtatacatacacgaccggtgctcgatttagtgtagtgtgaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcactcttcccg

SEQ ID NO: 567042 - DNA, 481 bp, Homo sapiens
  misc_feature: HIJSMM301A2YA4.43.64.F09.1.454.light.4.raw
tgtgagtagtcacgaccggtgctcgatttagcgcgtatacaagggggagtcagtctcagtcaggacacagcatggacatgagggtccccgctcagctcctggggctcctgctactctggctccgaggtggcagatgtgacatccagatgacccagtctccatcctccctgtctgcatctgtgggggacagagtcaccatcacttgtcgggcaagtcagtccgttaggcattatttaaattggtatcggcagagaccagggatggcccctcagctcatgatctacgctgcttccactctgcaaattggggtcccatcaacgttcagtggcagtgggtctgggacatatttcactctcaccatcaccagtctggaacctgaagattttgcaacttacttctgccaacagacttacagtctccctctcactttcggcggagggaccacagtggagatcaaaggaactgtggctgcaccatctgt

SEQ ID NO: 567043 - DNA, 503 bp, Homo sapiens; identical to SEQ ID NO: 536834
  misc_feature: HIJSMM301A48LQ.2.35.D02.1.454.light.4.raw

SEQ ID NO: 567044 - DNA, 508 bp, Homo sapiens; identical to SEQ ID NO: 536388
  misc_feature: HIJSMM301B3900.11.57.F02.1.454.light.4.raw

SEQ ID NO: 567045 - DNA, 486 bp, Homo sapiens; identical to SEQ ID NO: 535917
  misc_feature: HIJSMM301BW07W.3.10.A10.1.454.light.4.raw

SEQ ID NO: 567046 - DNA, 547 bp, Homo sapiens
  misc_feature: HIJSMM301ADIZO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggtaacgtagggaccgaaggtacgaccgtccctacggttcgtagcccaacggaccgaacccccaacctacgtctactctcgttcctacccctccctcccgttcg

SEQ ID NO: 567047 - DNA, 483 bp, Homo sapiens
  misc_feature: HIJSMM301ENPIP.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaacgaactgtggctgcaccat

SEQ ID NO: 567048 - DNA, 500 bp, Homo sapiens
  misc_feature: HIJSMM301BSMS8.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgcccctc

SEQ ID NO: 567049 - DNA, 486 bp, Homo sapiens; identical to SEQ ID NO: 535043
  misc_feature: HIJSMM301DG32I.46.35.D02.1.454.light.4.raw

SEQ ID NO: 567050 - DNA, 482 bp, Homo sapiens
  misc_feature: HIJSMM301A01OA.3.5.A05.1.454.light.4.raw
agacgcactccacgaccggtgctcgatttagatagatagacaggggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatctgt

SEQ ID NO: 567051 - DNA, 496 bp, Homo sapiens
  misc_feature: HIJSMM301B8K0U.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggtaccgaagctggagatcaaccgaactgtggctgcaccatctgtt

SEQ ID NO: 567052 - DNA, 494 bp, Homo sapiens
  misc_feature: HIJSMM301ALAWJ.43.35.D02.1.454.light.4.raw
tgtgagtagtcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaatcaaacgaactagtggctgcaccatctgtcttcat

SEQ ID NO: 567053 - DNA, 509 bp, Homo sapiens
  misc_feature: HIJSMM301C0JR2.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggtagggcaccaaggtgaccgtcctaggtcagcccaaggctgccccctcggtcta

SEQ ID NO: 567054 - DNA, 498 bp, Homo sapiens
  misc_feature: HIJSMM301DQ1GH.40.87.H10.1.454.light.4.raw
tctagcgactcacgaccggtgctcgatttagcagtactgcgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctcg

SEQ ID NO: 567055 - DNA, 507 bp, Homo sapiens
  misc_feature: HIJSMM301DM1DK.11.57.F02.1.454.light.4.raw
  modified_base (485)..(485): a, c, t, g, unknown or other
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcnccatctgtcttcatcttccgcc

SEQ ID NO: 567056 - DNA, 486 bp, Homo sapiens
  misc_feature: HIJSMM301BQKVL.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgagggaccacggtcggagtgtcaagcgaactgtggctgcacc

SEQ ID NO: 567057 - DNA, 483 bp, Homo sapiens; identical to SEQ ID NO: 537371
  misc_feature: HIJSMM301CK8GB.13.55.E11.1.454.light.4.raw

SEQ ID NO: 567058 - DNA, 383 bp, Homo sapiens; identical to SEQ ID NO: 447524
  misc_feature: HIJSMM301DLC0S.41.26.C04.1.454.light.4.raw

SEQ ID NO: 567059 - DNA, 505 bp, Homo sapiens
  misc_feature: HIJSMM301D8CDG.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttcccgcc

SEQ ID NO: 567060 - DNA, 515 bp, Homo sapiens
  misc_feature: HIJSMM301CI11J.48.38.D05.1.454.light.4.raw
agtatacatacacgaccggtgctcgatttagtatctgatagttgggtttggggtcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgatttttcggcggagggaccaaactgaccgtcctgggtcagcccaaggctgccccctcggt

SEQ ID NO: 567061 - DNA, 492 bp, Homo sapiens
  misc_feature: HIJSMM301CLQBF.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcat

SEQ ID NO: 567062 - DNA, 444 bp, Homo sapiens; identical to SEQ ID NO: 535192
  misc_feature: HIJSMM301AYS86.5.9.A09.1.454.light.4.raw

SEQ ID NO: 567063 - DNA, 502 bp, Homo sapiens
  misc_feature: HIJSMM301CSIC8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatagttcggcggagggaccaaactgaccgtcctaggtcagccaaggctgccccctc

SEQ ID NO: 567064 - DNA, 477 bp, Homo sapiens
  misc_feature: HIJSMM301BBUHM.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgtaaggggaaagtaatgaagttaacactgtggatcaccttcggccaagggacacgactggagattaaacgaactgtggctgcaccatctgtcttcatcttcccgccatctgaagtatagtct

SEQ ID NO: 567065 - DNA, 492 bp, Homo sapiens
  misc_feature: HIJSMM301DGPRU.49.25.C03.1.454.light.4.raw
agtcgagagacacgaccggtgctcgatttagtagtgtagatttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcta

SEQ ID NO: 567066 - DNA, 485 bp, Homo sapiens; identical to SEQ ID NO: 536040
  misc_feature: HIJSMM301CHEKP.15.1.A01.1.454.light.4.raw

SEQ ID NO: 567067 - DNA, 494 bp, Homo sapiens; identical to SEQ ID NO: 534992
  misc_feature: HIJSMM301EQ9QI.9.1.A01.1.454.light.4.raw

SEQ ID NO: 567068 - DNA, 486 bp, Homo sapiens; identical to SEQ ID NO: 535043
  misc_feature: HIJSMM301AGGTM.46.35.D02.1.454.light.4.raw

SEQ ID NO: 567069 - DNA, 491 bp, Homo sapiens; identical to SEQ ID NO: 535176
  misc_feature: HIJSMM301BUX33.13.39.D06.1.454.light.4.raw

SEQ ID NO: 567070 - DNA, 495 bp, Homo sapiens; identical to SEQ ID NO: 538269
  misc_feature: HIJSMM301ALE70.9.1.A01.1.454.light.4.raw

SEQ ID NO: 567071 - DNA, 493 bp, Homo sapiens; identical to SEQ ID NO: 535745
  misc_feature: HIJSMM301EY2YK.47.78.H01.1.454.light.4.raw

SEQ ID NO: 567072 - DNA, 501 bp, Homo sapiens; identical to SEQ ID NO: 536142
  misc_feature: HIJSMM301CRG9F.15.1.A01.1.454.light.4.raw

SEQ ID NO: 567073 - DNA, 487 bp, Homo sapiens; identical to SEQ ID NO: 536272
  misc_feature: HIJSMM301AWDEE.17.25.C03.1.454.light.4.raw

SEQ ID NO: 567074 - DNA, 496 bp, Homo sapiens; identical to SEQ ID NO: 538625
  misc_feature: HIJSMM301C6AYZ.2.49.E05.1.454.light.4.raw

SEQ ID NO: 567075 - DNA, 490 bp, Homo sapiens; identical to SEQ ID NO: 538714
  misc_feature: HIJSMM301BM710.11.12.B01.1.454.light.4.raw

SEQ ID NO: 567076 - DNA, 490 bp, Homo sapiens
  misc_feature: HIJSMM301AQIBK.51.6.A06.1.454.light.4.raw
cgatcgtatacacgaccggtgctcgatttagatctactgacaggggtggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagaccccg

SEQ ID NO: 567077 - DNA, 490 bp, Homo sapiens; identical to SEQ ID NO: 537746
  misc_feature: HIJSMM301CUUYR.10.77.G11.1.454.light.4.raw

SEQ ID NO: 567078 - DNA, 497 bp, Homo sapiens
  misc_feature: HIJSMM301DEFXL.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaatcaaacgaactgtggctgcacc

SEQ ID NO: 567079 - DNA, 497 bp, Homo sapiens
  misc_feature: HIJSMM301C3OWY.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccatctgtcttcatctttccccg

SEQ ID NO: 567080 - DNA, 510 bp, Homo sapiens
  misc_feature: HIJSMM301DIOEX.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggagatgaagctgactactactgttactcaatagagaacagtgataatttctgggtgttcggcggagggaccaaactgaccgtcctaggtcagccaaggctcgccccctcggtcactctgttcccccg

SEQ ID NO: 567081 - DNA, 521 bp, Homo sapiens
  misc_feature: HIJSMM301BT34Y.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagccaacggctgccccctccggtcactctgttcccaccct

SEQ ID NO: 567082 - DNA, 495 bp, Homo sapiens
  misc_feature: HIJSMM301DJFCK.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgagatttgcggtttattactgtcagcagtataataactggcctccacggtacacttttggccaggggaccaagctggagatcaaacgaactgtggctgcaccatctgtt

SEQ ID NO: 567083 - DNA, 508 bp, Homo sapiens
  misc_feature: HIJSMM301EK6O3.16.1.A01.1.454.light.4.raw
tgtactactccacgaccggtgctcgatttagacgtctcatcaggagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcg

SEQ ID NO: 567084 - DNA, 454 bp, Homo sapiens; identical to SEQ ID NO: 536943
  misc_feature: HIJSMM301DRIPP.19.86.H09.1.454.light.4.raw

SEQ ID NO: 567085 - DNA, 498 bp, Homo sapiens; identical to SEQ ID NO: 538749
  misc_feature: HIJSMM301EV1RW.43.34.D01.1.454.light.4.raw

SEQ ID NO: 567086 - DNA, 494 bp, Homo sapiens; identical to SEQ ID NO: 535680
  misc_feature: HIJSMM301D79BI.16.78.H01.1.454.light.4.raw

SEQ ID NO: 567087 - DNA, 485 bp, Homo sapiens; identical to SEQ ID NO: 536040
  misc_feature: HIJSMM301EETOZ.15.1.A01.1.454.light.4.raw

SEQ ID NO: 567088 - DNA, 486 bp, Homo sapiens; identical to SEQ ID NO: 536329
  misc_feature: HIJSMM301B5OGU.21.4.A04.1.454.light.4.raw

SEQ ID NO: 567089 - DNA, 442 bp, Homo sapiens
  misc_feature: HIJSMM301CDMH8.11.3.A03.1.454.light.4.raw
cgagagataccacgaccggtgctcgatttagagagcgtcacagggtccgtgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccagtaaccgtcctaggtcagcccaaggctcgccccctcggtcactctgttcccaccctcctcgtatctctcg

SEQ ID NO: 567090 - DNA, 510 bp, Homo sapiens
  misc_feature: HIJSMM301BUSXO.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgggacactcccgtggtattcggtcggagggaccaaggtgaccgtccgtaggtcagcccaaggctcgtccccccg

SEQ ID NO: 567091 - DNA, 501 bp, Homo sapiens
  misc_feature: HIJSMM301DSQYW.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcagcagcactcagggttttcggtcgggagggaccaagctgaccgtcctaggtcagcccaaggctgccccctcggt

SEQ ID NO: 567092 - DNA, 447 bp, Homo sapiens; identical to SEQ ID NO: 535201
  misc_feature: HIJSMM301BD15S.18.9.A09.1.454.light.4.raw

SEQ ID NO: 567093 - DNA, 485 bp, Homo sapiens; identical to SEQ ID NO: 560039
  misc_feature: HIJSMM301B9QPX.41.54.E10.1.454.light.4.raw

SEQ ID NO: 567094 - DNA, 483 bp, Homo sapiens
  misc_feature: HIJSMM301CD383.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcggggccagtcagagtgttagcagcagcttagcctggtaccagcagaaacctggccaggctcccaggctcctcatctatggtgcatctacgagggccactggtatcccagccaggttcagtggcagtgggtctgggacaggagttcactctcaccatcagcagcctgcagtctgaagattttgctagtttattactgtcagcactataataactggcctccgtacaggttttggccaggggaccaagctggagatcaaacgaa

SEQ ID NO: 567095 - DNA, 383 bp, Homo sapiens; identical to SEQ ID NO: 447524
  misc_feature: HIJSMM301AQRGC.41.26.C04.1.454.light.4.raw

SEQ ID NO: 567096 - DNA, 495 bp, Homo sapiens
  misc_feature: HIJSMM301A0ZBK.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatactttcgtggacgttcggccaagggaccaaggtggatatcagacgaactagtggctgca

SEQ ID NO: 567097 - DNA, 441 bp, Homo sapiens; identical to SEQ ID NO: 535074
  misc_feature: HIJSMM301B437V.11.3.A03.1.454.light.4.raw

SEQ ID NO: 567098 - DNA, 444 bp, Homo sapiens; identical to SEQ ID NO: 535027
  misc_feature: HIJSMM301BH130.8.73.G07.1.454.light.4.raw

SEQ ID NO: 567099 - DNA, 495 bp, Homo sapiens; identical to SEQ ID NO: 536487
  misc_feature: HIJSMM301ADRZY.52.86.H09.1.454.light.4.raw

SEQ ID NO: 567100 - DNA, 486 bp, Homo sapiens
  misc_feature: HIJSMM301DHYUP.49.28.C06.1.454.light.4.raw
agtcgagagacacgaccggtgctcgatttagagctcacgtattgggtttggggaggaatcagtcccactcaggacacagcatggacatgagggtccccgctcagctcctggggctcctgctgctctggttcccaggtgccaggtgtggcatccaggtgacccagtctccatcctccctgtctgcatctgtaggagacagagtcaccatcacctgccgggcaagtcaggacattagaaacgatttaggctggtatcagcagaaagcagggcaagcccctaagcgcctgatctatggtgcagccagtttgcacggtggggtcccatcaagattcagcggcagtggatctgggacagaattcactctcacaatcagcagcctgcagcctgaagattttgcaacttattactgtctacagcataatagtaacccttggacgttcggccaaggaccagggtggaaatcaaacgaactagtggctgcaccta

SEQ ID NO: 567101 - DNA, 515 bp, Homo sapiens
  misc_feature: HIJSMM301CWXBT.52.11.A11.1.454.light.4.raw
cgcagtacgacacgaccggtgctcgatttagctacgactgcagggggatcaggactcctcagttcaccttctcacaatgaggctccctgctcagctcctggggctgctaatgctctgggtcccagggtgcactggggatgttgtggtgactcagtctcctctctccctgcccgtcacccttggacaggcggcctccatctcctgcaggtctagtcacagcctcctacacagtgatggaaacacctacttgagttggtttcagcagaggcctggccaatctccaaggcgccttatttataaggtttctaatcgggactctggggtcccagacagattcagcggcagtgggtcaggcactgacttcacactgaaaatcagcagggtggaggctgaggatgttggggtttattactgcatgcaaggtacacactggcctccgtacactttgttcgacgggaccggaacgacgtacgacgagtacaagaaacgtaagtggtcgtggcaccactacttcg

SEQ ID NO: 567102 - DNA, 501 bp, Homo sapiens
  misc_feature: HIJSMM301EMZG5.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccaagactggagatcaaacgaactgtggctgcacca

SEQ ID NO: 567103 - DNA, 503 bp, Homo sapiens
  misc_feature: HIJSMM301DESLA.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagccaaggctgccccctcggt

SEQ ID NO: 567104 - DNA, 499 bp, Homo sapiens
  misc_feature: HIJSMM301DEAYW.19.71.G05.1.454.light.4.raw
tactctcgtgcacgaccggtgctcgatttagtgtcgtcgcaagagagaggggggggtacgaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgaactgtggctgca

SEQ ID NO: 567105 - DNA, 447 bp, Homo sapiens; identical to SEQ ID NO: 535201
  misc_feature: HIJSMM301DVX3F.18.9.A09.1.454.light.4.raw

SEQ ID NO: 567106 - DNA, 517 bp, Homo sapiens
  misc_feature: HIJSMM301ESBRB.47.86.H09.1.454.light.4.raw
agctcacgtacacgaccggtgctcgatttagtgctatagacttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccctcct

SEQ ID NO: 567107 - DNA, 490 bp, Homo sapiens; identical to SEQ ID NO: 543909
  misc_feature: HIJSMM301BZTPL.14.55.E11.1.454.light.4.raw

SEQ ID NO: 567108 - DNA, 455 bp, Homo sapiens
  misc_feature: HIJSMM301DYUAJ.19.86.H09.1.454.light.4.raw
tactctcgtgcacgaccggtgctcgatttagtgctatagacttgggtttgggggccggttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctggtcactctgttcccgccctcctccacgagagta

SEQ ID NO: 567109 - DNA, 445 bp, Homo sapiens
  misc_feature: HIJSMM301CYT4N.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttccccaccctcctccatactcgta

SEQ ID NO: 567110 - DNA, 507 bp, Homo sapiens
  misc_feature: HIJSMM301CCA01.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatggatgacagcctgaatggtccggtattcggcggagggaccaagctgaccgtcctcggtcagcccaaggctgccccctc

SEQ ID NO: 567111 - DNA, 505 bp, Homo sapiens; identical to SEQ ID NO: 538054
  misc_feature: HIJSMM301EO8Q9.8.55.E11.1.454.light.4.raw

SEQ ID NO: 567112 - DNA, 488 bp, Homo sapiens
  misc_feature: HIJSMM301DMFPK.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggtagggaccaagctgaccgtcctaggtcacg

SEQ ID NO: 567113 - DNA, 494 bp, Homo sapiens
  misc_feature: HIJSMM301AMB6U.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcggtaccgacgagtggagtgtctaacgaactagt

SEQ ID NO: 567114 - DNA, 513 bp, Homo sapiens
  misc_feature: HIJSMM301EG9VQ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacgggttgggtgttcggcggagggaccaagctgaccgtcctaggtcagcccaaggctgccccctggtcactctgttcccaccctcctcgctactaga

SEQ ID NO: 567115 - DNA, 383 bp, Homo sapiens; identical to SEQ ID NO: 447524
  misc_feature: HIJSMM301AGDD9.41.26.C04.1.454.light.4.raw

SEQ ID NO: 567116 - DNA, 516 bp, Homo sapiens
  misc_feature: HIJSMM301BE4HN.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcact

SEQ ID NO: 567117 - DNA, 486 bp, Homo sapiens
  misc_feature: HIJSMM301A5N8E.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccagggaccaaggtaggatatcagacgaa

SEQ ID NO: 567118 - DNA, 476 bp, Homo sapiens; identical to SEQ ID NO: 538026
  misc_feature: HIJSMM301ADII9.13.76.G10.1.454.light.4.raw

SEQ ID NO: 567119 - DNA, 488 bp, Homo sapiens; identical to SEQ ID NO: 535081
  misc_feature: HIJSMM301BVFH7.26.23.C01.1.454.light.4.raw

SEQ ID NO: 567120 - DNA, 490 bp, Homo sapiens; identical to SEQ ID NO: 560912
  misc_feature: HIJSMM301CT8YG.41.25.C03.1.454.light.4.raw

SEQ ID NO: 567121 - DNA, 489 bp, Homo sapiens; identical to SEQ ID NO: 537328
  misc_feature: HIJSMM301DYQRH.13.5.A05.1.454.light.4.raw

SEQ ID NO: 567122 - DNA, 510 bp, Homo sapiens
  misc_feature: HIJSMM301BGVY7.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaaggctcgcccctcggtcactctcgttccct

SEQ ID NO: 567123 - DNA, 518 bp, Homo sapiens; identical to SEQ ID NO: 536231
  misc_feature: HIJSMM301D7YN1.22.30.C08.1.454.light.4.raw

SEQ ID NO: 567124 - DNA, 463 bp, Homo sapiens; identical to SEQ ID NO: 545937
  misc_feature: HIJSMM301DBCXN.17.28.C06.1.454.light.4.raw

SEQ ID NO: 567125 - DNA, 509 bp, Homo sapiens
  misc_feature: HIJSMM301A2LYG.49.55.E11.1.454.light.4.raw
agtcgagagacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggtcggcgggaccaggctgaccgtcctgggtcagccaaggctgcccctcggtcgactctgttcccta

SEQ ID NO: 567126 - DNA, 493 bp, Homo sapiens
  misc_feature: HIJSMM301DUNFB.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtgctgcaccatctgtcttcatt

SEQ ID NO: 567127 - DNA, 497 bp, Homo sapiens; identical to SEQ ID NO: 545672
  misc_feature: HIJSMM301BKQIH.2.49.E05.1.454.light.4.raw

SEQ ID NO: 567128 - DNA, 505 bp, Homo sapiens
  misc_feature: HIJSMM301DJ1V4.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggccctcctgacaatctctgggctccaggctgacgacgaggctaattattactgctgctcatatgaaggttataacactatactattcggcggagggaccaagctgaccgtcctgcgtcagcccaaggctgccccctcggtcacttccg

SEQ ID NO: 567129 - DNA, 508 bp, Homo sapiens
  misc_feature: HIJSMM301CPJ5S.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacgggatccccgatcgcttcatgggctccagttctggggctgaccgctacctcaccatcctccaacctccagtctgacgatgaggctgagtatcactggtggagagagccacacaattgatggccaaaggcggttgggtgttcggcggagggaccaagctgaccgtcctaggtcagcccaaggctgccccctggtcactctgttccccaccctcctcg

SEQ ID NO: 567130 - DNA, 507 bp, Homo sapiens; identical to SEQ ID NO: 550515
  misc_feature: HIJSMM301DL2EY.12.73.G07.1.454.light.4.raw

SEQ ID NO: 567131 - DNA, 404 bp, Homo sapiens; identical to SEQ ID NO: 535530
  misc_feature: HIJSMM301EXUAG.4.35.D02.1.454.light.4.raw

SEQ ID NO: 567132 - DNA, 444 bp, Homo sapiens; identical to SEQ ID NO: 535027
  misc_feature: HIJSMM301CNOMD.8.73.G07.1.454.light.4.raw

SEQ ID NO: 567133 - DNA, 497 bp, Homo sapiens; identical to SEQ ID NO: 535664
  misc_feature: HIJSMM301ETJMB.22.14.B03.1.454.light.4.raw

SEQ ID NO: 567134 - DNA, 488 bp, Homo sapiens
  misc_feature: HIJSMM301AONZF.13.87.H10.1.454.light.4.raw
tcacgtactacacgaccggtgctcgatttagcagtactgcgttgggtttggggagtcagtcccagtcaggacacagcatggacatgagggtccccgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgcaccatctgtt

SEQ ID NO: 567135 - DNA, 494 bp, Homo sapiens; identical to SEQ ID NO: 534994
  misc_feature: HIJSMM301CBYKJ.27.78.H01.1.454.light.4.raw

SEQ ID NO: 567136 - DNA, 512 bp, Homo sapiens
  misc_feature: HIJSMM301CPXXI.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccctaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 567137 - DNA, 502 bp, Homo sapiens; identical to SEQ ID NO: 543695
  misc_feature: HIJSMM301EDWP6.19.78.H01.1.454.light.4.raw

SEQ ID NO: 567138 - DNA, 485 bp, Homo sapiens; identical to SEQ ID NO: 535501
  misc_feature: HIJSMM301DD8WP.3.10.A10.1.454.light.4.raw

SEQ ID NO: 567139 - DNA, 497 bp, Homo sapiens; identical to SEQ ID NO: 536371
  misc_feature: HIJSMM301C19SR.16.78.H01.1.454.light.4.raw

SEQ ID NO: 567140 - DNA, 495 bp, Homo sapiens; identical to SEQ ID NO: 538269
  misc_feature: HIJSMM301E3OST.9.1.A01.1.454.light.4.raw

SEQ ID NO: 567141 - DNA, 497 bp, Homo sapiens
  misc_feature: HIJSMM301BDLFW.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggaggaccaaggtgaccgtcctacgtcagcccaaggctgccccctcggtcactctccg

SEQ ID NO: 567142 - DNA, 486 bp, Homo sapiens; identical to SEQ ID NO: 535385
  misc_feature: HIJSMM301A9X3J.19.71.G05.1.454.light.4.raw

SEQ ID NO: 567143 - DNA, 508 bp, Homo sapiens; identical to SEQ ID NO: 536388
  misc_feature: HIJSMM301C1IWB.11.57.F02.1.454.light.4.raw

SEQ ID NO: 567144 - DNA, 476 bp, Homo sapiens; identical to SEQ ID NO: 537368
  misc_feature: HIJSMM301DQCAN.7.83.H06.1.454.light.4.raw

SEQ ID NO: 567145 - DNA, 440 bp, Homo sapiens; identical to SEQ ID NO: 543785
  misc_feature: HIJSMM301DCXLS.4.22.B11.1.454.light.4.raw

SEQ ID NO: 567146 - DNA, 497 bp, Homo sapiens; identical to SEQ ID NO: 536371
  misc_feature: HIJSMM301EF18X.16.78.H01.1.454.light.4.raw

SEQ ID NO: 567147 - DNA, 466 bp, Homo sapiens
  misc_feature: HIJSMM301BQLLC.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcactactgtcaacagagtgacagcacgcctcacactttcggcggagggaccaaggtggaggatcaaacgaa

SEQ ID NO: 567148 - DNA, 507 bp, Homo sapiens
  misc_feature: HIJSMM301ETTFT.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaacggtaggaaagtacaaacgaaactagtggcgtgcaccatctgtcttcatcttcccg

SEQ ID NO: 567149 - DNA, 491 bp, Homo sapiens
  misc_feature: HIJSMM301ESXD3.48.1.A01.1.454.light.4.raw
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccactttcggcggagggaccagggtggacgtcaacgaactgtggctgcacatctgtcttcatcttcccg

SEQ ID NO: 567150 - DNA, 475 bp, Homo sapiens
  misc_feature: HIJSMM301BMV9L.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccgaaggtggagatcaagacg

SEQ ID NO: 567151 - DNA, 502 bp, Homo sapiens; identical to SEQ ID NO: 539314
  misc_feature: HIJSMM301C50FG.21.81.H04.1.454.light.4.raw

SEQ ID NO: 567152 - DNA, 511 bp, Homo sapiens
  misc_feature: HIJSMM301DUAR3.10.28.C06.1.454.light.4.raw
catagtagtgcacgaccggtgctcgatttagagctcacgtattggggtttgggggggtctcaggaggcggccctctcgggacgtctccaccatggcctgggctctgctattcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtcact

SEQ ID NO: 567153 - DNA, 477 bp, Homo sapiens
  misc_feature: HIJSMM301AV4B6.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgcta

SEQ ID NO: 567154 - DNA, 481 bp, Homo sapiens
  misc_feature: HIJSMM301AQXOC.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccagggaccaagctggagatcaggcgaactgtggctgca

SEQ ID NO: 567155 - DNA, 483 bp, Homo sapiens
  misc_feature: HIJSMM301ELYXU.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtgctgcaccat

SEQ ID NO: 567156 - DNA, 447 bp, Homo sapiens; identical to SEQ ID NO: 563113
  misc_feature: HIJSMM301EYF9A.18.9.A09.1.454.light.4.raw

SEQ ID NO: 567157 - DNA, 492 bp, Homo sapiens
  misc_feature: HIJSMM301D05XU.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcaatataatacctggcctccgctcactttcggcggagggaccaaggttgagatcaaacgaactgtggctgcaccatctgtt

SEQ ID NO: 567158 - DNA, 487 bp, Homo sapiens
  misc_feature: HIJSMM301DAN2T.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcgatgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccac

SEQ ID NO: 567159 - DNA, 490 bp, Homo sapiens; identical to SEQ ID NO: 536481
  misc_feature: HIJSMM301EITBA.13.46.E02.1.454.light.4.raw

SEQ ID NO: 567160 - DNA, 503 bp, Homo sapiens
  misc_feature: HIJSMM301DDY4M.12.48.E04.1.454.light.4.raw
atacgacgtacacgaccggtgctcgatttagagagcgtcacagagagaagggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcact

SEQ ID NO: 567161 - DNA, 514 bp, Homo sapiens; identical to SEQ ID NO: 565828
  misc_feature: HIJSMM301C9E6R.8.43.D10.1.454.light.4.raw

SEQ ID NO: 567162 - DNA, 499 bp, Homo sapiens
  misc_feature: HIJSMM301DCBJ9.27.78.H01.1.454.light.4.raw
  modified_base (459)..(459): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggagtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactggagtaac

SEQ ID NO: 567163 - DNA, 506 bp, Homo sapiens
  misc_feature: HIJSMM301DOVX7.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgcc

SEQ ID NO: 567164 - DNA, 502 bp, Homo sapiens
  misc_feature: HIJSMM301CTXY5.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggatgaatgaggggtgcagagaactccatggctaccaggtcagcccaaggccaaccccactgtcactctgttcccaccctcctcta

SEQ ID NO: 567165 - DNA, 468 bp, Homo sapiens
  misc_feature: HIJSMM301EZQNZ.49.29.C07.1.454.light.4.raw
agtcgagagacacgaccggtgctcgatttagagtgctacgaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaa

SEQ ID NO: 567166 - DNA, 517 bp, Homo sapiens
  misc_feature: HIJSMM301ESJ4Y.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtccact

SEQ ID NO: 567167 - DNA, 503 bp, Homo sapiens
  misc_feature: HIJSMM301DW5QZ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctcctctacgtctat

SEQ ID NO: 567168 - DNA, 478 bp, Homo sapiens; identical to SEQ ID NO: 535129
  misc_feature: HIJSMM301CVNYZ.11.11.A11.1.454.light.4.raw

SEQ ID NO: 567169 - DNA, 496 bp, Homo sapiens
  misc_feature: HIJSMM301BJ4O5.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctgtt

SEQ ID NO: 567170 - DNA, 494 bp, Homo sapiens
  misc_feature: HIJSMM301DGR9G.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgt

SEQ ID NO: 567171 - DNA, 505 bp, Homo sapiens; identical to SEQ ID NO: 535503
  misc_feature: HIJSMM301C0H8F.8.28.C06.1.454.light.4.raw

SEQ ID NO: 567172 - DNA, 478 bp, Homo sapiens; identical to SEQ ID NO: 535129
  misc_feature: HIJSMM301A4M9H.11.11.A11.1.454.light.4.raw

SEQ ID NO: 567173 - DNA, 495 bp, Homo sapiens; identical to SEQ ID NO: 535007
  misc_feature: HIJSMM301DKNPJ.22.5.A05.1.454.light.4.raw

SEQ ID NO: 567174 - DNA, 484 bp, Homo sapiens; identical to SEQ ID NO: 535400
  misc_feature: HIJSMM301AJB04.46.26.C04.1.454.light.4.raw

SEQ ID NO: 567175 - DNA, 484 bp, Homo sapiens; identical to SEQ ID NO: 535211
  misc_feature: HIJSMM301B9VWG.47.46.E02.1.454.light.4.raw

SEQ ID NO: 567176 - DNA, 503 bp, Homo sapiens
  misc_feature: HIJSMM301CLGOL.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctggtcagcccaaggctgcccctcggtcactctgttcccaccctcctctacgtcgtat

SEQ ID NO: 567177 - DNA, 485 bp, Homo sapiens
  misc_feature: HIJSMM301A1XXJ.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtgacattcggccaaggtaccaaggtggacatcagacgaactgtggctgcacc

SEQ ID NO: 567178 - DNA, 477 bp, Homo sapiens
  misc_feature: HIJSMM301BYAIQ.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaacctgtggctgcacca

SEQ ID NO: 567179 - DNA, 494 bp, Homo sapiens
  misc_feature: HIJSMM301B6SIQ.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcact

SEQ ID NO: 567180 - DNA, 447 bp, Homo sapiens; identical to SEQ ID NO: 535201
  misc_feature: HIJSMM301BCTY3.18.9.A09.1.454.light.4.raw

SEQ ID NO: 567181 - DNA, 508 bp, Homo sapiens
  misc_feature: HIJSMM301AOSZE.51.37.D04.1.454.light.4.raw
cgatcgtatacacgaccggtgctcgatttagtagcatactgttgggtttgggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttggttttattactgcatgcaaggtacacactggcctgggacgttcggccaagggaccaaggtggaaatcaaacgaactgtggctgcaccatctgtctt

SEQ ID NO: 567182 - DNA, 478 bp, Homo sapiens; identical to SEQ ID NO: 535129
  misc_feature: HIJSMM301D04X4.11.11.A11.1.454.light.4.raw

SEQ ID NO: 567183 - DNA, 507 bp, Homo sapiens; identical to SEQ ID NO: 536226
  misc_feature: HIJSMM301B3TJ5.18.37.D04.1.454.light.4.raw

SEQ ID NO: 567184 - DNA, 455 bp, Homo sapiens; identical to SEQ ID NO: 550024
  misc_feature: HIJSMM301A1I6U.19.86.H09.1.454.light.4.raw

SEQ ID NO: 567185 - DNA, 487 bp, Homo sapiens
  misc_feature: HIJSMM301EIY7I.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcgagatcagacgaactgtggctgcaccatctgtcttca

SEQ ID NO: 567186 - DNA, 505 bp, Homo sapiens
  misc_feature: HIJSMM301B3G6Z.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 567187 - DNA, 489 bp, Homo sapiens
  misc_feature: HIJSMM301CRXK0.40.86.H09.1.454.light.4.raw
tctagcgactcacgaccggtgctcgatttagtgctatagacttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcaggcgggtctgggacagatttcactctcaccatcaccagcctgcaggctgaagatgtggcggtttattactgtcaacatattctggtcaatctcattctttcggcggaggaccaaggtggagatcagacgaactgt

SEQ ID NO: 567188 - DNA, 463 bp, Homo sapiens; identical to SEQ ID NO: 535062
  misc_feature: HIJSMM301A6QZO.11.73.G07.1.454.light.4.raw

SEQ ID NO: 567189 - DNA, 495 bp, Homo sapiens
  misc_feature: HIJSMM301DJF0N.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaaccctcggacgttcggccagggaccgaaggtggaaagtacaaaacgaacctagtggctggcaccaa

SEQ ID NO: 567190 - DNA, 487 bp, Homo sapiens
  misc_feature: HIJSMM301CLSDD.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagattcatcttaccctcggaccgttcggtccgagggaccgacggtggagtgtcaagacgaactgtggcgtgcacact

SEQ ID NO: 567191 - DNA, 486 bp, Homo sapiens
  misc_feature: HIJSMM301CJXSR.22.73.G07.1.454.light.4.raw
  modified_base (479)..(479): a, c, t, g, unknown or other
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgcccagtgggtctgggacagagttcactctcaccatcagcagcctgcagtctgaagattttgcactttattactgtcagcaatataatgactggttctcgatcaccttcggccaagggacacgactggagattaaacgaaactgtgcgtgnaccatct

SEQ ID NO: 567192 - DNA, 522 bp, Homo sapiens; identical to SEQ ID NO: 549481
  misc_feature: HIJSMM301CBEKK.49.9.A09.1.454.light.4.raw

SEQ ID NO: 567193 - DNA, 454 bp, Homo sapiens; identical to SEQ ID NO: 536642
  misc_feature: HIJSMM301A9XZ5.19.86.H09.1.454.light.4.raw

SEQ ID NO: 567194 - DNA, 492 bp, Homo sapiens
  misc_feature: HIJSMM301AREXX.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcat

SEQ ID NO: 567195 - DNA, 484 bp, Homo sapiens
  misc_feature: HIJSMM301CADR1.47.46.E02.1.454.light.4.raw
  modified_base (459)..(459): a, c, t, g, unknown or other
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactgganattaaacgaactgtggctgcaccat

SEQ ID NO: 567196 - DNA, 497 bp, Homo sapiens
  misc_feature: HIJSMM301EWMOA.27.78.H01.1.454.light.4.raw
agcgtcgtctcacgaccggtgctcgatttagtgtgagtagtttgggtttggggggcatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 567197 - DNA, 498 bp, Homo sapiens
  misc_feature: HIJSMM301EINBQ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagcccaaggcctacc

SEQ ID NO: 567198 - DNA, 455 bp, Homo sapiens; identical to SEQ ID NO: 550155
  misc_feature: HIJSMM301EDFNT.5.86.H09.1.454.light.4.raw

SEQ ID NO: 567199 - DNA, 447 bp, Homo sapiens; identical to SEQ ID NO: 535020
  misc_feature: HIJSMM301D0900.18.9.A09.1.454.light.4.raw

SEQ ID NO: 567200 - DNA, 492 bp, Homo sapiens; identical to SEQ ID NO: 536175
  misc_feature: HIJSMM301C0U46.19.83.H06.1.454.light.4.raw

SEQ ID NO: 567201 - DNA, 447 bp, Homo sapiens; identical to SEQ ID NO: 535020
  misc_feature: HIJSMM301A471U.18.9.A09.1.454.light.4.raw

SEQ ID NO: 567202 - DNA, 494 bp, Homo sapiens; identical to SEQ ID NO: 545671
  misc_feature: HIJSMM301C30HG.9.1.A01.1.454.light.4.raw

SEQ ID NO: 567203 - DNA, 495 bp, Homo sapiens; identical to SEQ ID NO: 535007
  misc_feature: HIJSMM301EYFW3.22.5.A05.1.454.light.4.raw

SEQ ID NO: 567204 - DNA, 489 bp, Homo sapiens
  misc_feature: HIJSMM301DEP8O.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccgaaggtggagatcaagcgaactgtggctgcaccat

SEQ ID NO: 567205 - DNA, 505 bp, Homo sapiens
  misc_feature: HIJSMM301AD7FG.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcg

SEQ ID NO: 567206 - DNA, 507 bp, Homo sapiens
  misc_feature: HIJSMM301A5JYP.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctggaccaaagtggatatcaaacgaactgtggctgcaccatctgtcttcta

SEQ ID NO: 567207 - DNA, 455 bp, Homo sapiens; identical to SEQ ID NO: 552052
  misc_feature: HIJSMM301AOPT1.19.86.H09.1.454.light.4.raw

SEQ ID NO: 567208 - DNA, 493 bp, Homo sapiens
  misc_feature: HIJSMM301B5A3J.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacagactggagattaaaggaactgtggctgcaccatctgtcttcatcttccccg

SEQ ID NO: 567209 - DNA, 510 bp, Homo sapiens; identical to SEQ ID NO: 537801
  misc_feature: HIJSMM301AKXD1.5.60.F05.1.454.light.4.raw

SEQ ID NO: 567210 - DNA, 490 bp, Homo sapiens
  misc_feature: HIJSMM301AKC6T.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccgcctcctctacgtcgtat

SEQ ID NO: 567211 - DNA, 507 bp, Homo sapiens
  misc_feature: HIJSMM301A1QKW.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaaactgtggctgcaccatctgtctt

SEQ ID NO: 567212 - DNA, 476 bp, Homo sapiens; identical to SEQ ID NO: 537368
  misc_feature: HIJSMM301B2EFU.7.83.H06.1.454.light.4.raw

SEQ ID NO: 567213 - DNA, 486 bp, Homo sapiens; identical to SEQ ID NO: 535385
  misc_feature: HIJSMM301BEJD4.19.71.G05.1.454.light.4.raw

SEQ ID NO: 567214 - DNA, 518 bp, Homo sapiens
  misc_feature: HIJSMM301ADOYZ.22.30.C08.1.454.light.4.raw
acatacgcgtcacgaccggtgctcgatttagtctgacgtcaaagggaaaggggagagctctagggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 567215 - DNA, 495 bp, Homo sapiens; identical to SEQ ID NO: 538250
  misc_feature: HIJSMM301CA747.10.33.C11.1.454.light.4.raw

SEQ ID NO: 567216 - DNA, 503 bp, Homo sapiens; identical to SEQ ID NO: 536002
  misc_feature: HIJSMM301AL3FH.51.23.C01.1.454.light.4.raw

SEQ ID NO: 567217 - DNA, 494 bp, Homo sapiens; identical to SEQ ID NO: 535828
  misc_feature: HIJSMM301CX6VU.3.36.D03.1.454.light.4.raw

SEQ ID NO: 567218 - DNA, 475 bp, Homo sapiens
  misc_feature: HIJSMM301ES9LJ.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggaccaaggtggagatcaaacgaactagt

SEQ ID NO: 567219 - DNA, 485 bp, Homo sapiens
  misc_feature: HIJSMM301AG6O4.52.73.G07.1.454.light.4.raw
cgcagtacgacacgaccggtgctcgatttagctctacgctcaggggactgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggtccaggggaccaagctggagatcaaacgaactagt

SEQ ID NO: 567220 - DNA, 504 bp, Homo sapiens
  misc_feature: HIJSMM301CX5BX.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccctcct

SEQ ID NO: 567221 - DNA, 503 bp, Homo sapiens; identical to SEQ ID NO: 536834
  misc_feature: HIJSMM301BWDTV.2.35.D02.1.454.light.4.raw

SEQ ID NO: 567222 - DNA, 484 bp, Homo sapiens; identical to SEQ ID NO: 535240
  misc_feature: HIJSMM301DW45H.47.60.F05.1.454.light.4.raw

SEQ ID NO: 567223 - DNA, 448 bp, Homo sapiens
  misc_feature: HIJSMM301ETN2U.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccactactcgta

SEQ ID NO: 567224 - DNA, 508 bp, Homo sapiens
  misc_feature: HIJSMM301BQWRY.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccatctgtcttcatt

SEQ ID NO: 567225 - DNA, 490 bp, Homo sapiens
  misc_feature: HIJSMM301BUSD7.5.57.F02.1.454.light.4.raw
atcagacacgcacgaccggtgctcgatttagctcgatatagttgggtttggggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgccacatctgtct

SEQ ID NO: 567226 - DNA, 464 bp, Homo sapiens
  misc_feature: HIJSMM301AKF7V.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaactgtggctgcaccatctgtcttcatcttcccgcatctgaagtatagtct

SEQ ID NO: 567227 - DNA, 511 bp, Homo sapiens
  misc_feature: HIJSMM301C6TB5.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctcctctacgtagctc

SEQ ID NO: 567228 - DNA, 508 bp, Homo sapiens
  misc_feature: HIJSMM301BP7ZX.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccaacgtggaaatcaaacgaactgtggctgcaccatctgtcttcta

SEQ ID NO: 567229 - DNA, 502 bp, Homo sapiens
  misc_feature: HIJSMM301ED45Y.4.39.D06.1.454.light.4.raw
  modified_base (429)..(429): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatncaggcagttacaatgtgatattcggcggagggaccaaatgaccgtcctaggtcaagcccaaggctgccccctc

SEQ ID NO: 567230 - DNA, 479 bp, Homo sapiens; identical to SEQ ID NO: 542895
  misc_feature: HIJSMM301DJ64N.40.59.F04.1.454.light.4.raw

SEQ ID NO: 567231 - DNA, 486 bp, Homo sapiens; identical to SEQ ID NO: 550553
  misc_feature: HIJSMM301AGLAO.46.35.D02.1.454.light.4.raw

SEQ ID NO: 567232 - DNA, 464 bp, Homo sapiens
  misc_feature: HIJSMM301CFG3A.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacaggtaagggggacgggatccctgatcgcttctcaggctccagctctggggctgagcgctacctcaccatctccagcctccagtctgaggatgaggctgactattactgtcagacctggggcacgtggcaatagtt

SEQ ID NO: 567233 - DNA, 482 bp, Homo sapiens; identical to SEQ ID NO: 538815
  misc_feature: HIJSMM301AT8PH.4.34.D01.1.454.light.4.raw

SEQ ID NO: 567234 - DNA, 447 bp, Homo sapiens; identical to SEQ ID NO: 535020
  misc_feature: HIJSMM301AEG4E.18.9.A09.1.454.light.4.raw

SEQ ID NO: 567235 - DNA, 476 bp, Homo sapiens
  misc_feature: HIJSMM301AUBP6.40.1.A01.1.454.light.4.raw
tctagcgactcacgaccggtgctcgatttagacgtctcatcaggggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaagtactcctgttttggtccaggggaccgaaggtggagatcaaacgaactagtggctgcaccat

SEQ ID NO: 567236 - DNA, 448 bp, Homo sapiens; identical to SEQ ID NO: 538166
  misc_feature: HIJSMM301CLQJ5.18.9.A09.1.454.light.4.raw

SEQ ID NO: 567237 - DNA, 485 bp, Homo sapiens; identical to SEQ ID NO: 536576
  misc_feature: HIJSMM301BM29M.46.35.D02.1.454.light.4.raw

SEQ ID NO: 567238 - DNA, 482 bp, Homo sapiens
  misc_feature: HIJSMM301ANJQV.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaaatacaaacgaactgtgg

SEQ ID NO: 567239 - DNA, 496 bp, Homo sapiens; identical to SEQ ID NO: 538625
  misc_feature: HIJSMM301BZKKV.2.49.E05.1.454.light.4.raw

SEQ ID NO: 567240 - DNA, 502 bp, Homo sapiens
  misc_feature: HIJSMM301EVT5E.40.53.E09.1.454.light.4.raw
tctagcgactcacgaccggtgctcgatttagagagagtgtgttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggttcggcggggggaccgaagctgaccgtcctaagtcagcccaac

SEQ ID NO: 567241 - DNA, 497 bp, Homo sapiens
  misc_feature: HIJSMM301DSRP7.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaacccca

SEQ ID NO: 567242 - DNA, 494 bp, Homo sapiens; identical to SEQ ID NO: 549057
  misc_feature: HIJSMM301DII7P.10.33.C11.1.454.light.4.raw

SEQ ID NO: 567243 - DNA, 487 bp, Homo sapiens; identical to SEQ ID NO: 558003
  misc_feature: HIJSMM301BHOPZ.47.70.G04.1.454.light.4.raw

SEQ ID NO: 567244 - DNA, 483 bp, Homo sapiens
  misc_feature: HIJSMM301CBMIW.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcac

SEQ ID NO: 567245 - DNA, 506 bp, Homo sapiens; identical to SEQ ID NO: 553279
  misc_feature: HIJSMM301D3NPR.14.3.A03.1.454.light.4.raw

SEQ ID NO: 567246 - DNA, 504 bp, Homo sapiens
  misc_feature: HIJSMM301DXD53.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcgggcggagggaccaagctgaccgtcctaagtcagcccaaggctgccccctcggtca

SEQ ID NO: 567247 - DNA, 495 bp, Homo sapiens; identical to SEQ ID NO: 535596
  misc_feature: HIJSMM301AV0XQ.10.79.H02.1.454.light.4.raw

SEQ ID NO: 567248 - DNA, 480 bp, Homo sapiens; identical to SEQ ID NO: 558689
  misc_feature: HIJSMM301C4OAR.5.12.B01.1.454.light.4.raw

SEQ ID NO: 567249 - DNA, 489 bp, Homo sapiens; identical to SEQ ID NO: 536013
  misc_feature: HIJSMM301ASP3C.26.23.C01.1.454.light.4.raw

SEQ ID NO: 567250 - DNA, 454 bp, Homo sapiens; identical to SEQ ID NO: 534964
  misc_feature: HIJSMM301EGL6T.19.86.H09.1.454.light.4.raw

SEQ ID NO: 567251 - DNA, 489 bp, Homo sapiens; identical to SEQ ID NO: 535139
  misc_feature: HIJSMM301EI46Y.14.55.E11.1.454.light.4.raw

SEQ ID NO: 567252 - DNA, 496 bp, Homo sapiens
  misc_feature: HIJSMM301BCHF3.41.47.E03.1.454.light.4.raw
  modified_base (493)..(493): a, c, t, g, unknown or other
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaaatcaagtagagtggaggctgaggatgttggcgactattactgcctgcaagctcggcaattcccgaatcaccttcggccccgggacaccgactggacaattaaacgaactgnggt

SEQ ID NO: 567253 - DNA, 495 bp, Homo sapiens
  misc_feature: HIJSMM301B44LA.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtcaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggaccaagggacacgactggagattaaaggaactgtggctgcaccatctgtcttcatcttccccg

SEQ ID NO: 567254 - DNA, 506 bp, Homo sapiens
  misc_feature: HIJSMM301CMKK7.48.16.B05.1.454.light.4.raw
agtatacatacacgaccggtgctcgatttagagctcacgtaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggtcggagggaccaaactgaccgtcctcggtcggcccaaggctgccccctcggtcactcttcg

SEQ ID NO: 567255 - DNA, 509 bp, Homo sapiens
  misc_feature: HIJSMM301EWVWT.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactaacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtgccgtttattactgtcagcaatattatggtactcctccgtggacgttcggccgaagggaccaaggtggaaagtacaaacgaaactagtggctcgcacca

SEQ ID NO: 567256 - DNA, 504 bp, Homo sapiens; identical to SEQ ID NO: 536385
  misc_feature: HIJSMM301ELO00.27.78.H01.1.454.light.4.raw

SEQ ID NO: 567257 - DNA, 489 bp, Homo sapiens; identical to SEQ ID NO: 540247
  misc_feature: HIJSMM301EP8Z8.48.75.G09.1.454.light.4.raw

SEQ ID NO: 567258 - DNA, 441 bp, Homo sapiens; identical to SEQ ID NO: 534971
  misc_feature: HIJSMM301CE0IJ.11.3.A03.1.454.light.4.raw

SEQ ID NO: 567259 - DNA, 497 bp, Homo sapiens
  misc_feature: HIJSMM301EOSA3.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccgatacgaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 567260 - DNA, 496 bp, Homo sapiens; identical to SEQ ID NO: 553382
  misc_feature: HIJSMM301AP03T.51.59.F04.1.454.light.4.raw

SEQ ID NO: 567261 - DNA, 484 bp, Homo sapiens; identical to SEQ ID NO: 539370
  misc_feature: HIJSMM301BWAOT.22.73.G07.1.454.light.4.raw

SEQ ID NO: 567262 - DNA, 499 bp, Homo sapiens
  misc_feature: HIJSMM301EW8PJ.43.42.D09.1.454.light.4.raw
tgtgagtagtcacgaccggtgctcgatttagacacatacgcagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggaggatacaaacgaactgtggctgcaccatctgtcttcta

SEQ ID NO: 567263 - DNA, 505 bp, Homo sapiens
  misc_feature: HIJSMM301BX22L.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccaagctgccccctggtcactctgtt

SEQ ID NO: 567264 - DNA, 494 bp, Homo sapiens; identical to SEQ ID NO: 536974
  misc_feature: HIJSMM301D2B38.16.86.H09.1.454.light.4.raw

SEQ ID NO: 567265 - DNA, 486 bp, Homo sapiens; identical to SEQ ID NO: 535043
  misc_feature: HIJSMM301ATQH5.46.35.D02.1.454.light.4.raw

SEQ ID NO: 567266 - DNA, 383 bp, Homo sapiens; identical to SEQ ID NO: 447524
  misc_feature: HIJSMM301DZZ23.41.26.C04.1.454.light.4.raw

SEQ ID NO: 567267 - DNA, 492 bp, Homo sapiens; identical to SEQ ID NO: 544810
  misc_feature: HIJSMM301CJLFE.11.81.H04.1.454.light.4.raw

SEQ ID NO: 567268 - DNA, 484 bp, Homo sapiens; identical to SEQ ID NO: 537086
  misc_feature: HIJSMM301A2BEH.5.39.D06.1.454.light.4.raw

SEQ ID NO: 567269 - DNA, 504 bp, Homo sapiens; identical to SEQ ID NO: 536728
  misc_feature: HIJSMM301CQBK3.19.78.H01.1.454.light.4.raw

SEQ ID NO: 567270 - DNA, 477 bp, Homo sapiens
  misc_feature: HIJSMM301D0F9M.7.12.B01.1.454.light.4.raw
cgtgtctctacacgaccggtgctcgatttagtagtgtagattcacgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatccactttcggccctgggactgaagtgcatatgaagagaactgtggctgca

SEQ ID NO: 567271 - DNA, 493 bp, Homo sapiens; identical to SEQ ID NO: 535745
  misc_feature: HIJSMM301BOBI8.47.78.H01.1.454.light.4.raw

SEQ ID NO: 567272 - DNA, 517 bp, Homo sapiens
  misc_feature: HIJSMM301AT2SV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccgccctcctcc

SEQ ID NO: 567273 - DNA, 444 bp, Homo sapiens; identical to SEQ ID NO: 535594
  misc_feature: HIJSMM301DI0LG.9.9.A09.1.454.light.4.raw

SEQ ID NO: 567274 - DNA, 507 bp, Homo sapiens
  misc_feature: HIJSMM301BE36X.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaaggttgaccgtctaggtcagcccaaggctgccccctcggtcactctgttcccacct

SEQ ID NO: 567275 - DNA, 494 bp, Homo sapiens; identical to SEQ ID NO: 535276
  misc_feature: HIJSMM301A8466.16.6.A06.1.454.light.4.raw

SEQ ID NO: 567276 - DNA, 494 bp, Homo sapiens; identical to SEQ ID NO: 541183
  misc_feature: HIJSMM301BCQVU.19.71.G05.1.454.light.4.raw

SEQ ID NO: 567277 - DNA, 490 bp, Homo sapiens
  misc_feature: HIJSMM301E3YVD.51.71.G05.1.454.light.4.raw
cgatcgtatacacgaccggtgctcgatttagtgtcgtcgcaagagagaggggttagtgtcgtcgcaagagagaggggcacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaaatcaacagacacct

SEQ ID NO: 567278 - DNA, 505 bp, Homo sapiens; identical to SEQ ID NO: 551816
  misc_feature: HIJSMM301B29ZF.18.78.H01.1.454.light.4.raw

SEQ ID NO: 567279 - DNA, 486 bp, Homo sapiens; identical to SEQ ID NO: 535290
  misc_feature: HIJSMM301BTQPJ.3.12.B01.1.454.light.4.raw

SEQ ID NO: 567280 - DNA, 481 bp, Homo sapiens
  misc_feature: HIJSMM301DS2N6.13.55.E11.1.454.light.4.raw
tcacgtactacacgaccggtgctcgatttagcactcgcacgttggggtttggggactcaggacacagcatggacatgagggtccccgctcagctcctgggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaatggggtcccatcaaggttcagcggcagtggatctggcacagacttcattctcaccatcagcagcctgcagcctgaagattttgcaacttattactgtcttacaagatcacaattatcctgggacgttcggccaagggaccaaggtggaaatcaaacgaactgtgctgcacatctgtcttcta

SEQ ID NO: 567281 - DNA, 508 bp, Homo sapiens
  misc_feature: HIJSMM301AR015.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggacgaacggtaggaagtacaacgaactagtggctgcaccatctgtcttctatcttcccgccctact

SEQ ID NO: 567282 - DNA, 492 bp, Homo sapiens; identical to SEQ ID NO: 557028
  misc_feature: HIJSMM301D5L8M.51.6.A06.1.454.light.4.raw

SEQ ID NO: 567283 - DNA, 513 bp, Homo sapiens
  misc_feature: HIJSMM301CYB9F.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtggggggtgccacgttgggtgttcggcggagggaccaagctgaccgtccg

SEQ ID NO: 567284 - DNA, 513 bp, Homo sapiens
  misc_feature: HIJSMM301BS5DO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaacgggaccgaacggtaggaaagtacaaacgaactagtggctgcaccatctgtcttctactcttccccg

SEQ ID NO: 567285 - DNA, 444 bp, Homo sapiens; identical to SEQ ID NO: 535192
  misc_feature: HIJSMM301C49DP.5.9.A09.1.454.light.4.raw

SEQ ID NO: 567286 - DNA, 465 bp, Homo sapiens; identical to SEQ ID NO: 538589
  misc_feature: HIJSMM301CJFIF.12.39.D06.1.454.light.4.raw

SEQ ID NO: 567287 - DNA, 476 bp, Homo sapiens
  misc_feature: HIJSMM301CZVYI.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaaggtggaaatcaaacgaactgtggctgca

SEQ ID NO: 567288 - DNA, 495 bp, Homo sapiens; identical to SEQ ID NO: 535821
  misc_feature: HIJSMM301BWQVZ.3.31.C09.1.454.light.4.raw

SEQ ID NO: 567289 - DNA, 493 bp, Homo sapiens; identical to SEQ ID NO: 540880
  misc_feature: HIJSMM301EGNQF.40.81.H04.1.454.light.4.raw

SEQ ID NO: 567290 - DNA, 502 bp, Homo sapiens
  misc_feature: HIJSMM301B90MA.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatgcaggcatcaacactgttttcggcggagggaccaagctgaccgtcctaggtcagcccaaggctgccccctcggtca

SEQ ID NO: 567291 - DNA, 499 bp, Homo sapiens
  misc_feature: HIJSMM301EIAXP.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttctagggtttccgtaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 567292 - DNA, 484 bp, Homo sapiens; identical to SEQ ID NO: 554992
  misc_feature: HIJSMM301C9VDH.46.26.C04.1.454.light.4.raw
  modified_base (433)..(433): a, c, t, g, unknown or other

SEQ ID NO: 567293 - DNA, 447 bp, Homo sapiens; identical to SEQ ID NO: 535201
  misc_feature: HIJSMM301EG03R.18.9.A09.1.454.light.4.raw

SEQ ID NO: 567294 - DNA, 494 bp, Homo sapiens; identical to SEQ ID NO: 543247
  misc_feature: HIJSMM301AQ03U.22.57.F02.1.454.light.4.raw

SEQ ID NO: 567295 - DNA, 485 bp, Homo sapiens; identical to SEQ ID NO: 542735
  misc_feature: HIJSMM301EI9KG.26.45.E01.1.454.light.4.raw

SEQ ID NO: 567296 - DNA, 500 bp, Homo sapiens
  misc_feature: HIJSMM301C7DNK.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgagacgttcgtcaaggaccaaggtggagatcaaacgaactgtggctgcaccatctgtcttcatcttccgccat

SEQ ID NO: 567297 - DNA, 491 bp, Homo sapiens; identical to SEQ ID NO: 536211
  misc_feature: HIJSMM301C6VW7.16.53.E09.1.454.light.4.raw

SEQ ID NO: 567298 - DNA, 494 bp, Homo sapiens; identical to SEQ ID NO: 534992
  misc_feature: HIJSMM301BYYSJ.9.1.A01.1.454.light.4.raw

SEQ ID NO: 567299 - DNA, 515 bp, Homo sapiens
  misc_feature: HIJSMM301EZU74.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtcactctgttccccg

SEQ ID NO: 567300 - DNA, 494 bp, Homo sapiens; identical to SEQ ID NO: 541035
  misc_feature: HIJSMM301AVNFC.26.12.B01.1.454.light.4.raw

SEQ ID NO: 567301 - DNA, 489 bp, Homo sapiens; identical to SEQ ID NO: 535139
  misc_feature: HIJSMM301AWDDA.14.55.E11.1.454.light.4.raw

SEQ ID NO: 567302 - DNA, 492 bp, Homo sapiens
  misc_feature: HIJSMM301BD26D.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgtccaaggaccaaggtaggacatcaaacgaactagtggctgcaccatctgtctt

SEQ ID NO: 567303 - DNA, 305 bp, Homo sapiens; identical to SEQ ID NO: 539887
  misc_feature: HIJSMM301BIFPK.49.19.B08.1.454.light.4.raw

SEQ ID NO: 567304 - DNA, 495 bp, Homo sapiens
  misc_feature: HIJSMM301A7V5F.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcggatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 567305 - DNA, 495 bp, Homo sapiens
  misc_feature: HIJSMM301DNOI2.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcgccgaaggaccgaacggtaggaaatacaaacgaaactagtggcgtcgcgaccact

SEQ ID NO: 567306 - DNA, 472 bp, Homo sapiens; identical to SEQ ID NO: 535898
  misc_feature: HIJSMM301D1F6O.15.8.A08.1.454.light.4.raw

SEQ ID NO: 567307 - DNA, 504 bp, Homo sapiens
  misc_feature: HIJSMM301AO791.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcagggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtca

SEQ ID NO: 567308 - DNA, 517 bp, Homo sapiens
  misc_feature: HIJSMM301ER4OF.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaatttttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgacgtcctaagtcagcccaaggctgcccctcggtcactctgttcccgccct

SEQ ID NO: 567309 - DNA, 488 bp, Homo sapiens; identical to SEQ ID NO: 535081
  misc_feature: HIJSMM301AIYNJ.26.23.C01.1.454.light.4.raw

SEQ ID NO: 567310 - DNA, 463 bp, Homo sapiens
  misc_feature: HIJSMM301AGBTP.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaacggtggagatccagcgaa

SEQ ID NO: 567311 - DNA, 488 bp, Homo sapiens; identical to SEQ ID NO: 536710
  misc_feature: HIJSMM301EAT2K.21.55.E11.1.454.light.4.raw

SEQ ID NO: 567312 - DNA, 497 bp, Homo sapiens; identical to SEQ ID NO: 536371
  misc_feature: HIJSMM301BNM5V.16.78.H01.1.454.light.4.raw

SEQ ID NO: 567313 - DNA, 444 bp, Homo sapiens; identical to SEQ ID NO: 534993
  misc_feature: HIJSMM301D19NA.5.9.A09.1.454.light.4.raw

SEQ ID NO: 567314 - DNA, 447 bp, Homo sapiens
  misc_feature: HIJSMM301AQLHE.18.73.G07.1.454.light.4.raw
tacgagtatgcacgaccggtgctcgatttagctctacgctcagggtcctgggcccagtctgggctgacgcagccgccctcactgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 567315 - DNA, 512 bp, Homo sapiens
  misc_feature: HIJSMM301CCM27.43.9.A09.1.454.light.4.raw
tgtgagtagtcacgaccggtgctcgatttagcgagacgcgcagggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaataaactttcctggacacctgcccgattctcaggctccctccttgggggcaaagctgccctgacccttcgggtgcgcagcctgaggatgaggctgactattactgcttgctcgcctatgatgctgctcgggttttcggcggaggaccgaagttgaccgtcctaggtcagcccaaggctgccccctcggtcactctgttcccgccctcctcactact

SEQ ID NO: 567316 - DNA, 499 bp, Homo sapiens
  misc_feature: HIJSMM301EYZFI.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcat

SEQ ID NO: 567317 - DNA, 493 bp, Homo sapiens
  misc_feature: HIJSMM301B4JZU.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagaattaacgaactgtggctgcaccatctgtctt

SEQ ID NO: 567318 - DNA, 509 bp, Homo sapiens
  misc_feature: HIJSMM301CLQYZ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccacgggaccgacagtagaatagagacgaactagtggcgtgcgaccaactctcgtcttctattcttcccgt

SEQ ID NO: 567319 - DNA, 489 bp, Homo sapiens; identical to SEQ ID NO: 541702
  misc_feature: HIJSMM301DPSYP.10.72.G06.1.454.light.4.raw

SEQ ID NO: 567320 - DNA, 512 bp, Homo sapiens
  misc_feature: HIJSMM301CMJ3K.27.78.H01.1.454.light.4.raw
  modified_base (438)..(438): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaagtcaccatcacctgccgggccagtcagagcgttggtagtagcttacactggtaccagcacgaaagccaggtcagtctccaaagctcctcatcaagtatgcttcccagtccttctcaggggtcccctcgaggttcagtggcaggtggatctgggacacatttcaccctcaccatcaatagcctggaagctgaagatgctgcaacttattacngtcatcagagtactactttacctcaagtgatccaaccttcggccaagggacaccgaactcggagattaaaaccg

SEQ ID NO: 567321 - DNA, 501 bp, Homo sapiens
  misc_feature: HIJSMM301AX9TV.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagtggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctgcccctcggtcactctgttcccgccctcctct

SEQ ID NO: 567322 - DNA, 499 bp, Homo sapiens
  misc_feature: HIJSMM301DC4CX.40.9.A09.1.454.light.4.raw
tctagcgactcacgaccggtgctcgatttagcgagacgcgcagggggagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtatttttgtcaacaacatgataagtcaccgttcagctttggccgggggacccaggtggagatcagacgaactgtggctgcaccatctgtcttcatcttccccg

SEQ ID NO: 567323 - DNA, 500 bp, Homo sapiens
  misc_feature: HIJSMM301BJCEB.53.24.C02.1.454.light.4.raw
  modified_base (256)..(256): a, c, t, g, unknown or other
cgcgtatacacacgaccggtgctcgatttagtacagatcgttagggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatgtcctgcactgggaccagttccaacatcggggcagnttaaaaatgatctacactggtatcagcaagttccaggaaccgcccccaaactcctcatctatggtaacaccaatcgaccctcaggggtccctgaccgattctctgcctccaagtctggcacctcagcctccctggccatcactgggctccagcctgaggatgaggctatttattactgccagtcctatgacaccagcctgagtggatcggtgttcggcggagggaccaaactgaccgtcctacg

SEQ ID NO: 567324 - DNA, 486 bp, Homo sapiens; identical to SEQ ID NO: 535043
  misc_feature: HIJSMM301CQ9NX.46.35.D02.1.454.light.4.raw

SEQ ID NO: 567325 - DNA, 491 bp, Homo sapiens
  misc_feature: HIJSMM301BGCEK.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgtgccaaggaccgaaggtggaaatacaaaacgaactagtggcgtgcaccatctgtcttcta

SEQ ID NO: 567326 - DNA, 486 bp, Homo sapiens
  misc_feature: HIJSMM301DAUWE.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaattacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 567327 - DNA, 537 bp, Homo sapiens
  misc_feature: HIJSMM301BA18N.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtagggaaggtacgtaaacgaaacctagtaggtcgtgtcgaccactactgtcttctactcttcccgtccctactctcgtat

SEQ ID NO: 567328 - DNA, 523 bp, Homo sapiens
  misc_feature: HIJSMM301BA3ZO.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcggggggaccaaggtgaccgtcctaagtcagcccaaggctgccccctcggtcactctcgtcccacctcctcacg

SEQ ID NO: 567329 - DNA, 448 bp, Homo sapiens
  misc_feature: HIJSMM301D6M9K.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaacccctctgtcactctgttctcaccctcctccatactcgta

SEQ ID NO: 567330 - DNA, 478 bp, Homo sapiens
  misc_feature: HIJSMM301C02C1.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtgctgcaccat

SEQ ID NO: 567331 - DNA, 489 bp, Homo sapiens; identical to SEQ ID NO: 535139
  misc_feature: HIJSMM301A5HTB.14.55.E11.1.454.light.4.raw

SEQ ID NO: 567332 - DNA, 506 bp, Homo sapiens
  misc_feature: HIJSMM301CD8M3.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcactatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 567333 - DNA, 474 bp, Homo sapiens
  misc_feature: HIJSMM301ASDMB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatacaaacgaa

SEQ ID NO: 567334 - DNA, 465 bp, Homo sapiens
  misc_feature: HIJSMM301AO17P.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcatttccggccctgggaccagagtggacatagaaacgtaa

SEQ ID NO: 567335 - DNA, 486 bp, Homo sapiens; identical to SEQ ID NO: 537310
  misc_feature: HIJSMM301DL3IC.15.28.C06.1.454.light.4.raw

SEQ ID NO: 567336 - DNA, 496 bp, Homo sapiens
  misc_feature: HIJSMM301DDY7J.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgttcagcagtatagtaactggcctccgtacacttttggccaggggaccaagctagaaatcaaacgaactgtggctgcaccatctgtcttcta

SEQ ID NO: 567337 - DNA, 508 bp, Homo sapiens
  misc_feature: HIJSMM301CNWV2.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggaccccaggtgaccgtcctacgtcagccc

SEQ ID NO: 567338 - DNA, 457 bp, Homo sapiens; identical to SEQ ID NO: 536586
  misc_feature: HIJSMM301ENCLX.49.85.H08.1.454.light.4.raw

SEQ ID NO: 567339 - DNA, 482 bp, Homo sapiens
  misc_feature: HIJSMM301D3J0E.49.29.C07.1.454.light.4.raw
agtcgagagacacgaccggtgctcgatttagagtgctacgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttgagatggtatcaacagaaaccagggaaagcccctaaactcctgatctatgctacattcgttttacaaagtggggtcccatcaaggttcagtggcagtggatctgggacagatttcactctcaccatcagcagtctgcaacctgaagattttgcaacttactactgtcaacagagttacagtaccccattcactttcggccctggaccaaagtggatatcaaacgaactgtgctgcaccat

SEQ ID NO: 567340 - DNA, 378 bp, Homo sapiens
  misc_feature: HIJSMM301EATZH.12.14.B03.1.454.light.4.raw
atacgacgtacacgaccggtgctcgatttagtgtgagtagtttgagtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgccctcctacgtcgact

SEQ ID NO: 567341 - DNA, 520 bp, Homo sapiens
  misc_feature: HIJSMM301BKZ32.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccaccct

SEQ ID NO: 567342 - DNA, 494 bp, Homo sapiens; identical to SEQ ID NO: 534992
  misc_feature: HIJSMM301AL4ER.9.1.A01.1.454.light.4.raw

SEQ ID NO: 567343 - DNA, 488 bp, Homo sapiens; identical to SEQ ID NO: 535990
  misc_feature: HIJSMM301A5P1A.11.28.C06.1.454.light.4.raw

SEQ ID NO: 567344 - DNA, 496 bp, Homo sapiens; identical to SEQ ID NO: 535109
  misc_feature: HIJSMM301D4FXZ.16.78.H01.1.454.light.4.raw

SEQ ID NO: 567345 - DNA, 495 bp, Homo sapiens; identical to SEQ ID NO: 537716
  misc_feature: HIJSMM301BTXEP.22.14.B03.1.454.light.4.raw

SEQ ID NO: 567346 - DNA, 497 bp, Homo sapiens; identical to SEQ ID NO: 538296
  misc_feature: HIJSMM301D6XOD.18.11.A11.1.454.light.4.raw

SEQ ID NO: 567347 - DNA, 508 bp, Homo sapiens
  misc_feature: HIJSMM301B6YQE.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagaaagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtctt

SEQ ID NO: 567348 - DNA, 488 bp, Homo sapiens
  misc_feature: HIJSMM301AUQ6Y.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcacatctgtcttcta

SEQ ID NO: 567349 - DNA, 484 bp, Homo sapiens; identical to SEQ ID NO: 556842
  misc_feature: HIJSMM301AGJ8E.26.70.G04.1.454.light.4.raw

SEQ ID NO: 567350 - DNA, 454 bp, Homo sapiens; identical to SEQ ID NO: 535005
  misc_feature: HIJSMM301BMWG6.19.86.H09.1.454.light.4.raw

SEQ ID NO: 567351 - DNA, 463 bp, Homo sapiens
  misc_feature: HIJSMM301BX2WC.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaacgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 567352 - DNA, 489 bp, Homo sapiens; identical to SEQ ID NO: 544582
  misc_feature: HIJSMM301BV934.22.65.F10.1.454.light.4.raw

SEQ ID NO: 567353 - DNA, 456 bp, Homo sapiens
  misc_feature: HIJSMM301DTMZJ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctcgtggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccaccctccccacaagta

SEQ ID NO: 567354 - DNA, 484 bp, Homo sapiens
  misc_feature: HIJSMM301EUQ3V.52.73.G07.1.454.light.4.raw
cgcagtacgacacgaccggtgctcgatttagctctacgctcaggggactgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaatcctcgcacttttggccaggggaccaagctggagatcaaacgaactgtgg

SEQ ID NO: 567355 - DNA, 516 bp, Homo sapiens
  misc_feature: HIJSMM301BU4A9.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 567356 - DNA, 493 bp, Homo sapiens
  misc_feature: HIJSMM301BO9JJ.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagacccg

SEQ ID NO: 567357 - DNA, 498 bp, Homo sapiens; identical to SEQ ID NO: 554147
  misc_feature: HIJSMM301CF026.51.27.C05.1.454.light.4.raw

SEQ ID NO: 567358 - DNA, 494 bp, Homo sapiens; identical to SEQ ID NO: 534994
  misc_feature: HIJSMM301COYTS.27.78.H01.1.454.light.4.raw

SEQ ID NO: 567359 - DNA, 505 bp, Homo sapiens
  misc_feature: HIJSMM301EMLT4.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccagggggaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatacaaacgaactgtggctgcaccatctgtctctatcttcccgcc

SEQ ID NO: 567360 - DNA, 521 bp, Homo sapiens; identical to SEQ ID NO: 539470
  misc_feature: HIJSMM301B25YT.27.23.C01.1.454.light.4.raw

SEQ ID NO: 567361 - DNA, 484 bp, Homo sapiens
  misc_feature: HIJSMM301D9CQ6.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcgggggaccaaagtggacgtcaaacgaactgtggctgcacca

SEQ ID NO: 567362 - DNA, 491 bp, Homo sapiens
  misc_feature: HIJSMM301BEKUQ.49.57.F02.1.454.light.4.raw
agtcgagagacacgaccggtgctcgatttagctcgatatagttgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 567363 - DNA, 488 bp, Homo sapiens; identical to SEQ ID NO: 557289
  misc_feature: HIJSMM301CTIKZ.12.51.E07.1.454.light.4.raw

SEQ ID NO: 567364 - DNA, 445 bp, Homo sapiens
  misc_feature: HIJSMM301BLJCC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttccaccctcctccatactcgta

SEQ ID NO: 567365 - DNA, 493 bp, Homo sapiens; identical to SEQ ID NO: 541489
  misc_feature: HIJSMM301BNJNG.12.23.C01.1.454.light.4.raw

SEQ ID NO: 567366 - DNA, 487 bp, Homo sapiens
  misc_feature: HIJSMM301CI2GC.48.61.F06.1.454.light.4.raw
agtatacatacacgaccggtgctcgatttagctacgctctaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctcgttcaccttcggcggcgggaccaaggtggagatcaaacgaactgtggctgcaccat

SEQ ID NO: 567367 - DNA, 518 bp, Homo sapiens
  misc_feature: HIJSMM301ALWNF.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtgggcaggtcagcccaaggccaaccccactgtcactctcg

SEQ ID NO: 567368 - DNA, 512 bp, Homo sapiens
  misc_feature: HIJSMM301D538O.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccgggatgaggccgactattactgtcaggtgtggagttttaatagtgatcatccgggggtattcggcggagggaccaaggtgaccgtcctacgtcagcccaaggctgccccctcggtcactctgttcccaccctcct

SEQ ID NO: 567369 - DNA, 492 bp, Homo sapiens
  misc_feature: HIJSMM301DKL5T.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcaccagcctgcagtctgaagattttgcagtctattactgtcagcaatataattactggctctctttcggcgggggaccaagctggagatcaaccgaactgtggctgcaccatctgtcttcta

SEQ ID NO: 567370 - DNA, 454 bp, Homo sapiens; identical to SEQ ID NO: 534964
  misc_feature: HIJSMM301BS7PH.19.86.H09.1.454.light.4.raw

SEQ ID NO: 567371 - DNA, 494 bp, Homo sapiens; identical to SEQ ID NO: 534992
  misc_feature: HIJSMM301AQ9QF.9.1.A01.1.454.light.4.raw

SEQ ID NO: 567372 - DNA, 511 bp, Homo sapiens
  misc_feature: HIJSMM301A865I.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 567373 - DNA, 507 bp, Homo sapiens
  misc_feature: HIJSMM301B9TO2.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgtttgggtgttcggcggagggaccaagctgaccgtcg

SEQ ID NO: 567374 - DNA, 460 bp, Homo sapiens; identical to SEQ ID NO: 536053
  misc_feature: HIJSMM301DW58Z.22.28.C06.1.454.light.4.raw

SEQ ID NO: 567375 - DNA, 498 bp, Homo sapiens
  misc_feature: HIJSMM301AUDR1.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttattgcaggcagtttcgctctcgaagtgttcggcggaggaccgagctgaccgtcctacgtcagcccaaggctcg

SEQ ID NO: 567376 - DNA, 498 bp, Homo sapiens
  misc_feature: HIJSMM301ES9G0.52.55.E11.1.454.light.4.raw
cgcagtacgacacgaccggtgctcgatttagcactcgcacgttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 567377 - DNA, 488 bp, Homo sapiens; identical to SEQ ID NO: 537527
  misc_feature: HIJSMM301CZ4PP.26.78.H01.1.454.light.4.raw

SEQ ID NO: 567378 - DNA, 486 bp, Homo sapiens
  misc_feature: HIJSMM301AVX8L.47.46.E02.1.454.light.4.raw
agctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 567379 - DNA, 519 bp, Homo sapiens
  misc_feature: HIJSMM301AE8AG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacggaccgaacggtaggaagtacgaaacgaactagtaggcgtgcaccactctgtcttctactcttcccgtcccact

SEQ ID NO: 567380 - DNA, 521 bp, Homo sapiens; identical to SEQ ID NO: 539470
  misc_feature: HIJSMM301BUGFB.27.23.C01.1.454.light.4.raw

SEQ ID NO: 567381 - DNA, 475 bp, Homo sapiens; identical to SEQ ID NO: 537714
  misc_feature: HIJSMM301EANLK.7.81.H04.1.454.light.4.raw

SEQ ID NO: 567382 - DNA, 480 bp, Homo sapiens
  misc_feature: HIJSMM301DR18F.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 567383 - DNA, 505 bp, Homo sapiens; identical to SEQ ID NO: 567205
  misc_feature: HIJSMM301AO8K3.15.86.H09.1.454.light.4.raw

SEQ ID NO: 567384 - DNA, 498 bp, Homo sapiens; identical to SEQ ID NO: 562772
  misc_feature: HIJSMM301BDV6M.40.70.G04.1.454.light.4.raw

SEQ ID NO: 567385 - DNA, 513 bp, Homo sapiens
  misc_feature: HIJSMM301EN2Y2.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggcccaaccccactgtcactctgttccccaccct

SEQ ID NO: 567386 - DNA, 441 bp, Homo sapiens; identical to SEQ ID NO: 535074
  misc_feature: HIJSMM301B5GY0.11.3.A03.1.454.light.4.raw

SEQ ID NO: 567387 - DNA, 490 bp, Homo sapiens; identical to SEQ ID NO: 538273
  misc_feature: HIJSMM301C0VXB.16.73.G07.1.454.light.4.raw

SEQ ID NO: 567388 - DNA, 469 bp, Homo sapiens; identical to SEQ ID NO: 536091
  misc_feature: HIJSMM301EE0KL.3.82.H05.1.454.light.4.raw

SEQ ID NO: 567389 - DNA, 507 bp, Homo sapiens
  misc_feature: HIJSMM301CIUBI.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatcg

SEQ ID NO: 567390 - DNA, 498 bp, Homo sapiens
  misc_feature: HIJSMM301CPNNT.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggatgaggctgactattactgccagtcctatgacatgacggctgagtgttcgtatgtcttcggatcgtggaccaaggtcaccgtctaagtcacgccaac

SEQ ID NO: 567391 - DNA, 486 bp, Homo sapiens
  misc_feature: HIJSMM301DFC0X.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttatactgtcaacagcttaataattacgcgctcacttcggtcggagggaccgaaggtaggaggatacaaacgaaactgtggctgcacccatcttcg

SEQ ID NO: 567392 - DNA, 509 bp, Homo sapiens; identical to SEQ ID NO: 543741
  misc_feature: HIJSMM301AW2F9.17.33.C11.1.454.light.4.raw

SEQ ID NO: 567393 - DNA, 486 bp, Homo sapiens; identical to SEQ ID NO: 535385
  misc_feature: HIJSMM301BA237.19.71.G05.1.454.light.4.raw

SEQ ID NO: 567394 - DNA, 502 bp, Homo sapiens
  misc_feature: HIJSMM301B1B6N.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtggaaagtacaaacgaactagtggcgtgcgaccatctgtcttcatt

SEQ ID NO: 567395 - DNA, 490 bp, Homo sapiens; identical to SEQ ID NO: 552647
  misc_feature: HIJSMM301AVJRN.40.44.D11.1.454.light.4.raw

SEQ ID NO: 567396 - DNA, 504 bp, Homo sapiens
  misc_feature: HIJSMM301CEEZW.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcacttc

SEQ ID NO: 567397 - DNA, 517 bp, Homo sapiens; identical to SEQ ID NO: 541566
  misc_feature: HIJSMM301DL5Z4.22.30.C08.1.454.light.4.raw

SEQ ID NO: 567398 - DNA, 504 bp, Homo sapiens; identical to SEQ ID NO: 561241
  misc_feature: HIJSMM301EQ7UC.10.71.G05.1.454.light.4.raw

SEQ ID NO: 567399 - DNA, 496 bp, Homo sapiens
  misc_feature: HIJSMM301BAZBS.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcacttcgtaggagggacgaggtggaggatcaaacgaactagtggcgtgcaccactactgtcttcta

SEQ ID NO: 567400 - DNA, 479 bp, Homo sapiens
  misc_feature: HIJSMM301AJTIM.21.14.B03.1.454.light.4.raw
tcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaccccgtacactttaggccaggggaccaagctggagatcaaacgaactgtggctgcacc

SEQ ID NO: 567401 - DNA, 485 bp, Homo sapiens
  misc_feature: HIJSMM301EYNNV.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtggagatcaaacgaactagtggcgtgcaccatc

SEQ ID NO: 567402 - DNA, 463 bp, Homo sapiens
  misc_feature: HIJSMM301EIYVV.11.73.G07.1.454.light.4.raw
cgagagataccacgaccggtgctcgatttagctctacgctcagggggcaggagtcaatcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 567403 - DNA, 494 bp, Homo sapiens; identical to SEQ ID NO: 535478
  misc_feature: HIJSMM301ESVMW.10.79.H02.1.454.light.4.raw

SEQ ID NO: 567404 - DNA, 380 bp, Homo sapiens; identical to SEQ ID NO: 540540
  misc_feature: HIJSMM301A5A3L.12.78.H01.1.454.light.4.raw

SEQ ID NO: 567405 - DNA, 504 bp, Homo sapiens
  misc_feature: HIJSMM301BVP62.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatggcccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatcagacgaactgtggctgcaccatctgtctt

SEQ ID NO: 567406 - DNA, 445 bp, Homo sapiens; identical to SEQ ID NO: 537719
  misc_feature: HIJSMM301DOI4Q.47.85.H08.1.454.light.4.raw

SEQ ID NO: 567407 - DNA, 521 bp, Homo sapiens; identical to SEQ ID NO: 549643
  misc_feature: HIJSMM301AL2RC.10.86.H09.1.454.light.4.raw

SEQ ID NO: 567408 - DNA, 504 bp, Homo sapiens; identical to SEQ ID NO: 539083
  misc_feature: HIJSMM301B62VV.8.19.B08.1.454.light.4.raw

SEQ ID NO: 567409 - DNA, 496 bp, Homo sapiens
  misc_feature: HIJSMM301DC6NP.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggtagtgtcaagacgaacgtgtggcgtgcaccatcttcg

SEQ ID NO: 567410 - DNA, 502 bp, Homo sapiens
  misc_feature: HIJSMM301EYSXM.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtccact

SEQ ID NO: 567411 - DNA, 518 bp, Homo sapiens; identical to SEQ ID NO: 539372
  misc_feature: HIJSMM301CQC37.7.86.H09.1.454.light.4.raw

SEQ ID NO: 567412 - DNA, 491 bp, Homo sapiens
  misc_feature: HIJSMM301CYL19.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcacatccgcggtctgcaacctgaagatttcgcaacttactactgtcaacagacttacagtgccccccgatcaccttcggccaagggacacgacctggagattaaacgaaactgtggctgcaccatctgtcttcatt

SEQ ID NO: 567413 - DNA, 486 bp, Homo sapiens; identical to SEQ ID NO: 535043
  misc_feature: HIJSMM301D66KI.46.35.D02.1.454.light.4.raw

SEQ ID NO: 567414 - DNA, 485 bp, Homo sapiens; identical to SEQ ID NO: 536872
  misc_feature: HIJSMM301DSP9P.26.23.C01.1.454.light.4.raw

SEQ ID NO: 567415 - DNA, 484 bp, Homo sapiens; identical to SEQ ID NO: 535240
  misc_feature: HIJSMM301AHBR2.47.60.F05.1.454.light.4.raw

SEQ ID NO: 567416 - DNA, 509 bp, Homo sapiens
  misc_feature: HIJSMM301E0DHA.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcta

SEQ ID NO: 567417 - DNA, 470 bp, Homo sapiens
  misc_feature: HIJSMM301BQDWG.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgt

SEQ ID NO: 567418 - DNA, 490 bp, Homo sapiens
  misc_feature: HIJSMM301C026S.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtttattactgtcagcagtatgatacctggcctccgtacacttttggccggggaccaagctggaatcaagcgaactgtggctgcaccatctgtcttcatt

SEQ ID NO: 567419 - DNA, 488 bp, Homo sapiens; identical to SEQ ID NO: 536056
  misc_feature: HIJSMM301C0WS4.47.36.D03.1.454.light.4.raw

SEQ ID NO: 567420 - DNA, 485 bp, Homo sapiens
  misc_feature: HIJSMM301AHS6C.49.69.G03.1.454.light.4.raw
agtcgagagacacgaccggtgctcgatttagtcgctgcgtaaaggagaaaggggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggccaggggaccaagttggagatcaaacgaactgtggctgcacca

SEQ ID NO: 567421 - DNA, 487 bp, Homo sapiens; identical to SEQ ID NO: 535583
  misc_feature: HIJSMM301DDR8B.22.73.G07.1.454.light.4.raw

SEQ ID NO: 567422 - DNA, 497 bp, Homo sapiens; identical to SEQ ID NO: 535886
  misc_feature: HIJSMM301DM7EY.8.10.A10.1.454.light.4.raw

SEQ ID NO: 567423 - DNA, 487 bp, Homo sapiens; identical to SEQ ID NO: 538190
  misc_feature: HIJSMM301BCIO4.47.70.G04.1.454.light.4.raw

SEQ ID NO: 567424 - DNA, 486 bp, Homo sapiens
  misc_feature: HIJSMM301CMHG3.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttgggctaggggaccaacctggagat

SEQ ID NO: 567425 - DNA, 547 bp, Homo sapiens
  misc_feature: HIJSMM301D6RO5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtagggaaaggttacgaaaaccgaaacgtacggtgggtcgtcggcgaccactactcgttcttcctacttcttcccgtcccactcctcgt

SEQ ID NO: 567426 - DNA, 479 bp, Homo sapiens
  misc_feature: HIJSMM301CNV8E.26.37.D04.1.454.light.4.raw
  modified_base (468)..(468): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggaggaccgaacggtgtagatnaacgaaactgt

SEQ ID NO: 567427 - DNA, 488 bp, Homo sapiens; identical to SEQ ID NO: 537124
  misc_feature: HIJSMM301A6FS1.11.25.C03.1.454.light.4.raw

SEQ ID NO: 567428 - DNA, 507 bp, Homo sapiens
  misc_feature: HIJSMM301C2L4M.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtctac

SEQ ID NO: 567429 - DNA, 478 bp, Homo sapiens
  misc_feature: HIJSMM301D0ME5.52.1.A01.1.454.light.4.raw
cgcagtacgacacgaccggtgctcgatttagacgtctcatcaggggagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctggaccatagtggatatcaaacgaactgtggctgcaccatctgtcttcta

SEQ ID NO: 567430 - DNA, 490 bp, Homo sapiens
  misc_feature: HIJSMM301CDJQH.22.65.F10.1.454.light.4.raw
  modified_base (417)..(417): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtnccccccgatcaccttcggccaagggacacgactggagattaaacgaactgtggctgcaccatctgtcttcatt

SEQ ID NO: 567431 - DNA, 494 bp, Homo sapiens; identical to SEQ ID NO: 534994
  misc_feature: HIJSMM301EGBRN.27.78.H01.1.454.light.4.raw

SEQ ID NO: 567432 - DNA, 525 bp, Homo sapiens
  misc_feature: HIJSMM301EN4W7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggccaacggaccgaacggtaggaaggtacgaaacgaactaagtggcgtggcaccaactactcgtcttctatcttcccgtccactctcgt

SEQ ID NO: 567433 - DNA, 496 bp, Homo sapiens
  misc_feature: HIJSMM301AE8AN.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttccccg

SEQ ID NO: 567434 - DNA, 488 bp, Homo sapiens; identical to SEQ ID NO: 537527
  misc_feature: HIJSMM301CB4UN.26.78.H01.1.454.light.4.raw

SEQ ID NO: 567435 - DNA, 447 bp, Homo sapiens; identical to SEQ ID NO: 535201
  misc_feature: HIJSMM301DWQIL.18.9.A09.1.454.light.4.raw

SEQ ID NO: 567436 - DNA, 485 bp, Homo sapiens
  misc_feature: HIJSMM301CA69H.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccaggtagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacggaactgtggctgca

SEQ ID NO: 567437 - DNA, 509 bp, Homo sapiens; identical to SEQ ID NO: 536047
  misc_feature: HIJSMM301ARADT.17.33.C11.1.454.light.4.raw

SEQ ID NO: 567438 - DNA, 476 bp, Homo sapiens
  misc_feature: HIJSMM301AYMJA.48.10.A10.1.454.light.4.raw
agtatacatacacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtcaggggaccaaagtggatgtcaaccgaactgtggctgcacca

SEQ ID NO: 567439 - DNA, 517 bp, Homo sapiens
  misc_feature: HIJSMM301DW3V0.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtctaagtcagcccaaggctgcccctcggtcactctgtcccaccct

SEQ ID NO: 567440 - DNA, 480 bp, Homo sapiens; identical to SEQ ID NO: 535291
  misc_feature: HIJSMM301E2WVT.22.59.F04.1.454.light.4.raw

SEQ ID NO: 567441 - DNA, 520 bp, Homo sapiens; identical to SEQ ID NO: 544672
  misc_feature: HIJSMM301CMFOT.27.23.C01.1.454.light.4.raw

SEQ ID NO: 567442 - DNA, 498 bp, Homo sapiens
  misc_feature: HIJSMM301D2HOV.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaagggtggagtatacagacgaactgtggctgca

SEQ ID NO: 567443 - DNA, 514 bp, Homo sapiens
  misc_feature: HIJSMM301BH1AH.14.78.H01.1.454.light.4.raw
cgtctagtaccacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 567444 - DNA, 490 bp, Homo sapiens; identical to SEQ ID NO: 536855
  misc_feature: HIJSMM301D7FTO.16.68.G02.1.454.light.4.raw

SEQ ID NO: 567445 - DNA, 492 bp, Homo sapiens; identical to SEQ ID NO: 540094
  misc_feature: HIJSMM301BMEQ8.9.34.D01.1.454.light.4.raw

SEQ ID NO: 567446 - DNA, 503 bp, Homo sapiens
  misc_feature: HIJSMM301CQJV6.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgcccctcggtcta

SEQ ID NO: 567447 - DNA, 498 bp, Homo sapiens
  misc_feature: HIJSMM301CTY40.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 567448 - DNA, 502 bp, Homo sapiens; identical to SEQ ID NO: 563566
  misc_feature: HIJSMM301CQN8U.41.45.E01.1.454.light.4.raw

SEQ ID NO: 567449 - DNA, 508 bp, Homo sapiens
  misc_feature: HIJSMM301DHTMU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaggaccaaggtggaagtcaagcgaactgtggctgcaccatctgtcttcatcttccgtcccat

SEQ ID NO: 567450 - DNA, 494 bp, Homo sapiens; identical to SEQ ID NO: 534994
  misc_feature: HIJSMM301CHUNJ.27.78.H01.1.454.light.4.raw

SEQ ID NO: 567451 - DNA, 498 bp, Homo sapiens
  misc_feature: HIJSMM301B4VEW.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgtaacttattactgccaacagtatcatcatcattgtaatttcggtggagggaccaaggtggaggtcaaacgaactgtggctgcaccatctgtcttcatcttccccg

SEQ ID NO: 567452 - DNA, 502 bp, Homo sapiens
  misc_feature: HIJSMM301A20FP.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtccaccgtcctaggtcagccccaaaggccaaccccca

SEQ ID NO: 567453 - DNA, 519 bp, Homo sapiens
  misc_feature: HIJSMM301BD2KS.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgttcaccctgaggacgaggctgagtattactgtctgctccactttcgtactgcctgggtcttcggcgggggactcagttgaccgtcctaggtcagcccaaggctgccccctcggtcactctgttcccgccctcctcactact

SEQ ID NO: 567454 - DNA, 518 bp, Homo sapiens; identical to SEQ ID NO: 563314
  misc_feature: HIJSMM301DUIUX.14.70.G04.1.454.light.4.raw

SEQ ID NO: 567455 - DNA, 486 bp, Homo sapiens; identical to SEQ ID NO: 535043
  misc_feature: HIJSMM301BMABM.46.35.D02.1.454.light.4.raw

SEQ ID NO: 567456 - DNA, 495 bp, Homo sapiens
  misc_feature: HIJSMM301BY6IP.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtggctccggtccgaggatgaggctgattattactgtgttggatgggacagcagcctgagtgcttatgtcttcggaactgggaccacggtcaccgtcct

SEQ ID NO: 567457 - DNA, 497 bp, Homo sapiens; identical to SEQ ID NO: 534982
  misc_feature: HIJSMM301AHEJQ.26.80.H03.1.454.light.4.raw

SEQ ID NO: 567458 - DNA, 503 bp, Homo sapiens
  misc_feature: HIJSMM301CPES7.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgagggtgcagagaactccatggctaccaggtcagcccaaggccaaccccactgtcactctcgttcccgccctcctcta

SEQ ID NO: 567459 - DNA, 502 bp, Homo sapiens
  misc_feature: HIJSMM301DULB0.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacgagggaggcgtgcgattttcggcggagggaccagtctgaccggtcctaggtcagcccaaggctgccccctcggtccactctcg

SEQ ID NO: 567460 - DNA, 494 bp, Homo sapiens; identical to SEQ ID NO: 535680
  misc_feature: HIJSMM301DK9B2.16.78.H01.1.454.light.4.raw

SEQ ID NO: 567461 - DNA, 487 bp, Homo sapiens; identical to SEQ ID NO: 537220
  misc_feature: HIJSMM301ECAGB.16.53.E09.1.454.light.4.raw

SEQ ID NO: 567462 - DNA, 492 bp, Homo sapiens
  misc_feature: HIJSMM301C5Q8M.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgagattttgcagtttttactgtcagcagtatagtaactggcctccgtacacttttggccaggggaccaagctagaaatcaaacgaactgtggctgcaccatctgtcttcta

SEQ ID NO: 567463 - DNA, 493 bp, Homo sapiens
  misc_feature: HIJSMM301CXSFJ.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcct

SEQ ID NO: 567464 - DNA, 494 bp, Homo sapiens; identical to SEQ ID NO: 534994
  misc_feature: HIJSMM301AJT5G.27.78.H01.1.454.light.4.raw

SEQ ID NO: 567465 - DNA, 498 bp, Homo sapiens
  misc_feature: HIJSMM301DH37D.41.35.D02.1.454.light.4.raw
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgcccctcggtcactctgttccccgcctcctcatagtataga

SEQ ID NO: 567466 - DNA, 504 bp, Homo sapiens
  misc_feature: HIJSMM301AM125.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaaggctgcccccc

SEQ ID NO: 567467 - DNA, 506 bp, Homo sapiens
  misc_feature: HIJSMM301CXBQZ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 567468 - DNA, 485 bp, Homo sapiens; identical to SEQ ID NO: 539299
  misc_feature: HIJSMM301D0F6J.3.10.A10.1.454.light.4.raw

SEQ ID NO: 567469 - DNA, 494 bp, Homo sapiens; identical to SEQ ID NO: 534992
  misc_feature: HIJSMM301D8SDW.9.1.A01.1.454.light.4.raw

SEQ ID NO: 567470 - DNA, 501 bp, Homo sapiens
  misc_feature: HIJSMM301A5DZX.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctggagagttggtttgggtttattacgtgcatgacaagctctaacaaccttcctacttacgtttcgccgagggaaccaagtcgtggagatacaaacgaact

SEQ ID NO: 567471 - DNA, 487 bp, Homo sapiens; identical to SEQ ID NO: 536272
  misc_feature: HIJSMM301C2FLD.17.25.C03.1.454.light.4.raw

SEQ ID NO: 567472 - DNA, 522 bp, Homo sapiens; identical to SEQ ID NO: 541090
  misc_feature: HIJSMM301D4SMO.27.23.C01.1.454.light.4.raw

SEQ ID NO: 567473 - DNA, 447 bp, Homo sapiens; identical to SEQ ID NO: 535020
  misc_feature: HIJSMM301CDM5H.18.9.A09.1.454.light.4.raw

SEQ ID NO: 567474 - DNA, 486 bp, Homo sapiens
  misc_feature: HIJSMM301EJRQS.51.30.C08.1.454.light.4.raw
cgatcgtatacacgaccggtgctcgatttagtctgacgtcaaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggccaagggaccaaggtggaaatacaaacgaactagtggctgcaccatctgtt

SEQ ID NO: 567475 - DNA, 486 bp, Homo sapiens; identical to SEQ ID NO: 535385
  misc_feature: HIJSMM301D0OGS.19.71.G05.1.454.light.4.raw

SEQ ID NO: 567476 - DNA, 502 bp, Homo sapiens
  misc_feature: HIJSMM301B43LV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacccaaatgaccgtcctaggtcagcccaa

SEQ ID NO: 567477 - DNA, 512 bp, Homo sapiens; identical to SEQ ID NO: 562782
  misc_feature: HIJSMM301DY56P.7.34.D01.1.454.light.4.raw

SEQ ID NO: 567478 - DNA, 507 bp, Homo sapiens; identical to SEQ ID NO: 538313
  misc_feature: HIJSMM301AQX5R.7.71.G05.1.454.light.4.raw

SEQ ID NO: 567479 - DNA, 486 bp, Homo sapiens; identical to SEQ ID NO: 535917
  misc_feature: HIJSMM301AK7PL.3.10.A10.1.454.light.4.raw

SEQ ID NO: 567480 - DNA, 496 bp, Homo sapiens
  misc_feature: HIJSMM301ASXO5.43.42.D09.1.454.light.4.raw
tgtgagtagtcacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaacgaaactgtggctgcaccatctgtcttcta

SEQ ID NO: 567481 - DNA, 484 bp, Homo sapiens
  misc_feature: HIJSMM301EZ9P8.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatagtggatatcaaacgaactagtggctgcaccatctgtt

SEQ ID NO: 567482 - DNA, 499 bp, Homo sapiens
  misc_feature: HIJSMM301BO833.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcacgcctgcaggctgaagatgtggctagtttattattgtcagcaatattatattcctcctcagacgttcggccgaaggaccaaggtaggaaatcaaacgaactgtggctgcacc

SEQ ID NO: 567483 - DNA, 486 bp, Homo sapiens; identical to SEQ ID NO: 535043
  misc_feature: HIJSMM301BC9BQ.46.35.D02.1.454.light.4.raw

SEQ ID NO: 567484 - DNA, 482 bp, Homo sapiens; identical to SEQ ID NO: 549843
  misc_feature: HIJSMM301CUXKH.3.38.D05.1.454.light.4.raw

SEQ ID NO: 567485 - DNA, 500 bp, Homo sapiens
  misc_feature: HIJSMM301DG2XF.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcccggagattttgcagtttattactgtcagcagtatggtactttcacaaaaccttcggccaggggacacgaactggagattaaagcgaaactgtggctgcaccatctgtcttc

SEQ ID NO: 567486 - DNA, 484 bp, Homo sapiens
  misc_feature: HIJSMM301CKNQB.12.57.F02.1.454.light.4.raw
atacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctcgatacttgatgattgttaacagtgatggcagccacaacaagggggacgggatccctgatcgcttctcaggctccagttctggggctgagcgctacctcaccatctccagcctccagtctgaggatgaggctgactattactgtcagacctggggcactggcattgtggtattcggcggagggacgaagctgaccgtcctgggtcagcccaaggctg

SEQ ID NO: 567487 - DNA, 440 bp, Homo sapiens; identical to SEQ ID NO: 546706
  misc_feature: HIJSMM301CEJ1N.11.3.A03.1.454.light.4.raw

SEQ ID NO: 567488 - DNA, 487 bp, Homo sapiens; identical to SEQ ID NO: 537573
  misc_feature: HIJSMM301CRV5B.3.10.A10.1.454.light.4.raw

SEQ ID NO: 567489 - DNA, 506 bp, Homo sapiens; identical to SEQ ID NO: 546231
  misc_feature: HIJSMM301ALK8Z.8.71.G05.1.454.light.4.raw

SEQ ID NO: 567490 - DNA, 503 bp, Homo sapiens
  misc_feature: HIJSMM301CJ4O4.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaagccggggatgaggccgactattactgtcaggtgtgggatagtagtggtgatcatccatacgtcttcggaactgggaccaaggtctcgtcctacgtcagccaaggccaacccactgtcactctgttcc

SEQ ID NO: 567491 - DNA, 504 bp, Homo sapiens
  misc_feature: HIJSMM301CS7OB.48.36.D03.1.454.light.4.raw
agtatacatacacgaccggtgctcgatttagctgcgtcacgatctctcttggggggggtctcaggaggcagcactctccggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 567492 - DNA, 519 bp, Homo sapiens
  misc_feature: HIJSMM301EP3JP.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggcccaacccactgtcactcttccg

SEQ ID NO: 567493 - DNA, 484 bp, Homo sapiens; identical to SEQ ID NO: 536162
  misc_feature: HIJSMM301B2Q4B.13.59.F04.1.454.light.4.raw

SEQ ID NO: 567494 - DNA, 499 bp, Homo sapiens; identical to SEQ ID NO: 550763
  misc_feature: HIJSMM301E3LYK.19.78.H01.1.454.light.4.raw

SEQ ID NO: 567495 - DNA, 494 bp, Homo sapiens; identical to SEQ ID NO: 535276
  misc_feature: HIJSMM301DYXGG.16.6.A06.1.454.light.4.raw

SEQ ID NO: 567496 - DNA, 502 bp, Homo sapiens
  misc_feature: HIJSMM301A1Y8J.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaaccccactgtcactctgtt

SEQ ID NO: 567497 - DNA, 485 bp, Homo sapiens; identical to SEQ ID NO: 535688
  misc_feature: HIJSMM301DIRRM.19.5.A05.1.454.light.4.raw

SEQ ID NO: 567498 - DNA, 507 bp, Homo sapiens
  misc_feature: HIJSMM301ETTYV.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggaccgtcaaacgaactgtggctgcaccatctgtcttcatcttcccgccc

SEQ ID NO: 567499 - DNA, 486 bp, Homo sapiens; identical to SEQ ID NO: 537127
  misc_feature: HIJSMM301C7VUP.3.77.G11.1.454.light.4.raw

SEQ ID NO: 567500 - DNA, 465 bp, Homo sapiens
  misc_feature: HIJSMM301DRO0K.51.28.C06.1.454.light.4.raw
cgatcgtatacacgaccggtgctcgatttagagctcacgtattgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggagatcaagcgaa

SEQ ID NO: 567501 - DNA, 443 bp, Homo sapiens
  misc_feature: HIJSMM301DX59V.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagtcggaatggcaattgggtattcggcggagggaccaagttgaccgtcctaagtcagcccaaggctgccccctggtcactctgttcccgccctcctctgtcgagcgt

SEQ ID NO: 567502 - DNA, 445 bp, Homo sapiens
  misc_feature: HIJSMM301AMVSN.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccaccctcctccgtgtctgat

SEQ ID NO: 567503 - DNA, 490 bp, Homo sapiens; identical to SEQ ID NO: 562759
  misc_feature: HIJSMM301CS3WG.19.71.G05.1.454.light.4.raw

SEQ ID NO: 567504 - DNA, 502 bp, Homo sapiens
  misc_feature: HIJSMM301DG48E.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttcccgc

SEQ ID NO: 567505 - DNA, 520 bp, Homo sapiens
  misc_feature: HIJSMM301DN8RE.27.23.C01.1.454.light.4.raw
  modified_base (516)..(516): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccnccct

SEQ ID NO: 567506 - DNA, 510 bp, Homo sapiens
  misc_feature: HIJSMM301DBLAZ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggacccaaagtggaaatcaaacgaactgtggctgcaccatctgtcttcatcttcccgccat

SEQ ID NO: 567507 - DNA, 504 bp, Homo sapiens; identical to SEQ ID NO: 538521
  misc_feature: HIJSMM301B1MGO.9.12.B01.1.454.light.4.raw

SEQ ID NO: 567508 - DNA, 486 bp, Homo sapiens; identical to SEQ ID NO: 537310
  misc_feature: HIJSMM301AOLO5.15.28.C06.1.454.light.4.raw

SEQ ID NO: 567509 - DNA, 504 bp, Homo sapiens
  misc_feature: HIJSMM301DNG5Y.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaaccaaactgaaccgtcctaggtcagcccaa

SEQ ID NO: 567510 - DNA, 447 bp, Homo sapiens; identical to SEQ ID NO: 535020
  misc_feature: HIJSMM301C8ATM.18.9.A09.1.454.light.4.raw

SEQ ID NO: 567511 - DNA, 477 bp, Homo sapiens
  misc_feature: HIJSMM301BUQC9.48.19.B08.1.454.light.4.raw
agtatacatacacgaccggtgctcgatttagtgagtcagtaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggaggaccaagctgaccgtcctaggtcag

SEQ ID NO: 567512 - DNA, 497 bp, Homo sapiens
  misc_feature: HIJSMM301BUJJP.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtgctgcacc

SEQ ID NO: 567513 - DNA, 500 bp, Homo sapiens; identical to SEQ ID NO: 565763
  misc_feature: HIJSMM301CLQB8.18.11.A11.1.454.light.4.raw

SEQ ID NO: 567514 - DNA, 506 bp, Homo sapiens
  misc_feature: HIJSMM301CVTDP.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcact

SEQ ID NO: 567515 - DNA, 505 bp, Homo sapiens; identical to SEQ ID NO: 535503
  misc_feature: HIJSMM301AU6LN.8.28.C06.1.454.light.4.raw

SEQ ID NO: 567516 - DNA, 484 bp, Homo sapiens; identical to SEQ ID NO: 466217
  misc_feature: HIJSMM301DCT8R.15.1.A01.1.454.light.4.raw

SEQ ID NO: 567517 - DNA, 514 bp, Homo sapiens; identical to SEQ ID NO: 546238
  misc_feature: HIJSMM301AUKM8.47.85.H08.1.454.light.4.raw

SEQ ID NO: 567518 - DNA, 506 bp, Homo sapiens; identical to SEQ ID NO: 540748
  misc_feature: HIJSMM301B7REG.18.37.D04.1.454.light.4.raw

SEQ ID NO: 567519 - DNA, 494 bp, Homo sapiens
  misc_feature: HIJSMM301ASHL3.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaacgaactgtggctgcaccatctgtctt

SEQ ID NO: 567520 - DNA, 467 bp, Homo sapiens; identical to SEQ ID NO: 564146
  misc_feature: HIJSMM301DB6WQ.13.4.A04.1.454.light.4.raw

SEQ ID NO: 567521 - DNA, 492 bp, Homo sapiens; identical to SEQ ID NO: 537666
  misc_feature: HIJSMM301B0IKI.43.33.C11.1.454.light.4.raw

SEQ ID NO: 567522 - DNA, 479 bp, Homo sapiens
  misc_feature: HIJSMM301ESF82.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacaccctgcgtggttttggctgttcggcgcgggacc

SEQ ID NO: 567523 - DNA, 494 bp, Homo sapiens; identical to SEQ ID NO: 534992
  misc_feature: HIJSMM301C4UET.9.1.A01.1.454.light.4.raw

SEQ ID NO: 567524 - DNA, 484 bp, Homo sapiens
  misc_feature: HIJSMM301DKKS5.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggaggaccaaggtggagatcaagcgaactgtggctgcaccat

SEQ ID NO: 567525 - DNA, 492 bp, Homo sapiens
  misc_feature: HIJSMM301EWRH5.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctcgttcccaccctcctctacgtgagct

SEQ ID NO: 567526 - DNA, 522 bp, Homo sapiens; identical to SEQ ID NO: 538091
  misc_feature: HIJSMM301DG94U.27.23.C01.1.454.light.4.raw

SEQ ID NO: 567527 - DNA, 503 bp, Homo sapiens; identical to SEQ ID NO: 540029
  misc_feature: HIJSMM301CTVEK.7.71.G05.1.454.light.4.raw

SEQ ID NO: 567528 - DNA, 485 bp, Homo sapiens; identical to SEQ ID NO: 538533
  misc_feature: HIJSMM301CAJJ5.47.78.H01.1.454.light.4.raw

SEQ ID NO: 567529 - DNA, 488 bp, Homo sapiens; identical to SEQ ID NO: 540922
  misc_feature: HIJSMM301DQSA3.14.55.E11.1.454.light.4.raw
  modified_base (427)..(427): a, c, t, g, unknown or other

SEQ ID NO: 567530 - DNA, 506 bp, Homo sapiens
  misc_feature: HIJSMM301BZEED.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctcgccccctcggtccta

SEQ ID NO: 567531 - DNA, 475 bp, Homo sapiens
  misc_feature: HIJSMM301D3UEZ.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccgaaggaccaaggtaggaaatacaaacgaa

SEQ ID NO: 567532 - DNA, 444 bp, Homo sapiens; identical to SEQ ID NO: 534993
  misc_feature: HIJSMM301EI2FI.5.9.A09.1.454.light.4.raw

SEQ ID NO: 567533 - DNA, 484 bp, Homo sapiens; identical to SEQ ID NO: 539003
  misc_feature: HIJSMM301CLH7L.10.1.A01.1.454.light.4.raw

SEQ ID NO: 567534 - DNA, 485 bp, Homo sapiens
  misc_feature: HIJSMM301EYTJH.47.38.D05.1.454.light.4.raw
  modified_base (474)..(474): a, c, t, g, unknown or other
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctcggggtccctagacaggttcagtggcagtggatcaggcacagattttacgctgaaaatcagtaggtggaggctgaggatgttggggtttattactgcatgcaagttctacaaacttcctacacttttggccagggaccaagctggngatcaaacgaa

SEQ ID NO: 567535 - DNA, 517 bp, Homo sapiens
  misc_feature: HIJSMM301DH0UM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcaggcgggtcgtgggacagatttcactctcaccatcagcagcctgcaggctgaagatgtggcagtttattactgtcaactagttttctcgggcgttcggccgaacgggaccgaaggtaggaaagtacaaacgaactagtggcgtgcaccactctgtcttcactccttccccg

SEQ ID NO: 567536 - DNA, 496 bp, Homo sapiens; identical to SEQ ID NO: 550328
  misc_feature: HIJSMM301DJ5X9.51.5.A05.1.454.light.4.raw

SEQ ID NO: 567537 - DNA, 501 bp, Homo sapiens; identical to SEQ ID NO: 536142
  misc_feature: HIJSMM301CP97J.15.1.A01.1.454.light.4.raw

SEQ ID NO: 567538 - DNA, 507 bp, Homo sapiens; identical to SEQ ID NO: 547974
  misc_feature: HIJSMM301BOZHU.12.55.E11.1.454.light.4.raw

SEQ ID NO: 567539 - DNA, 487 bp, Homo sapiens; identical to SEQ ID NO: 536206
  misc_feature: HIJSMM301D9YXD.47.38.D05.1.454.light.4.raw

SEQ ID NO: 567540 - DNA, 506 bp, Homo sapiens
  misc_feature: HIJSMM301BABD8.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatattaccgaggacgttcggtcaagggaccaaggtggagatcaacgaaactgtggctgcaccatctgtcttcattttcccgccat

SEQ ID NO: 567541 - DNA, 471 bp, Homo sapiens
  misc_feature: HIJSMM301B1U5M.18.76.G10.1.454.light.4.raw
tacgagtatgcacgaccggtgctcgatttagtcactcatacaggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 567542 - DNA, 497 bp, Homo sapiens; identical to SEQ ID NO: 534982
  misc_feature: HIJSMM301AT5AW.26.80.H03.1.454.light.4.raw

SEQ ID NO: 567543 - DNA, 510 bp, Homo sapiens
  misc_feature: HIJSMM301BEEU0.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccgggggccacgtttcggcccgtgggaccaaagtggatatcaaacgactgtggctgcaccatctgtcttcta

SEQ ID NO: 567544 - DNA, 503 bp, Homo sapiens
  misc_feature: HIJSMM301DZ912.41.53.E09.1.454.light.4.raw
tctatactatcacgaccggtgctcgatttagagagagtgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctgccccctcggtcactctgttccccacctcctcatacgtatacg

SEQ ID NO: 567545 - DNA, 501 bp, Homo sapiens
  misc_feature: HIJSMM301B7DV7.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctcggtccgaggatgaggctgactattactgtgcatcacgggacgcaacatgggatgacaatctgagcggttgggtgttcggcggagggacccaaatgaccgtcctaggtcagcccaa

SEQ ID NO: 567546 - DNA, 494 bp, Homo sapiens; identical to SEQ ID NO: 535828
  misc_feature: HIJSMM301BOX3R.3.36.D03.1.454.light.4.raw

SEQ ID NO: 567547 - DNA, 497 bp, Homo sapiens; identical to SEQ ID NO: 535286
  misc_feature: HIJSMM301DIQY2.18.59.F04.1.454.light.4.raw

SEQ ID NO: 567548 - DNA, 512 bp, Homo sapiens
  misc_feature: HIJSMM301CLV2V.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccacctcct

SEQ ID NO: 567549 - DNA, 509 bp, Homo sapiens; identical to SEQ ID NO: 535670
  misc_feature: HIJSMM301D4K83.47.23.C01.1.454.light.4.raw

SEQ ID NO: 567550 - DNA, 498 bp, Homo sapiens
  misc_feature: HIJSMM301BCTYR.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactagaaaatcagtagagtggaggctgaggatggttggtagtttattactgcatgacaagctactacaaacctcctctctactttcggcggacgggaccgaaggtggagtatacgaaacgaacgt

SEQ ID NO: 567551 - DNA, 504 bp, Homo sapiens
  misc_feature: HIJSMM301D0AZN.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccactgtca

SEQ ID NO: 567552 - DNA, 500 bp, Homo sapiens
  misc_feature: HIJSMM301B53M9.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaagg

SEQ ID NO: 567553 - DNA, 514 bp, Homo sapiens; identical to SEQ ID NO: 545978
  misc_feature: HIJSMM301EAZ6Y.17.33.C11.1.454.light.4.raw

SEQ ID NO: 567554 - DNA, 492 bp, Homo sapiens; identical to SEQ ID NO: 537666
  misc_feature: HIJSMM301CL9AI.43.33.C11.1.454.light.4.raw

SEQ ID NO: 567555 - DNA, 505 bp, Homo sapiens
  misc_feature: HIJSMM301BVAG2.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttccaccctcaccatcaatagcctggaagctgaagatgctgcaacttattactgtcatcagagtactactttacctcaagtgatcaccttcggccaagggacacgactggagattaaacg

SEQ ID NO: 567556 - DNA, 492 bp, Homo sapiens; identical to SEQ ID NO: 539815
  misc_feature: HIJSMM301EPBR6.51.81.H04.1.454.light.4.raw

SEQ ID NO: 567557 - DNA, 454 bp, Homo sapiens
  misc_feature: HIJSMM301DDQBO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcatccacgagagta

SEQ ID NO: 567558 - DNA, 485 bp, Homo sapiens; identical to SEQ ID NO: 535822
  misc_feature: HIJSMM301C9XUG.14.53.E09.1.454.light.4.raw

SEQ ID NO: 567559 - DNA, 488 bp, Homo sapiens; identical to SEQ ID NO: 535990
  misc_feature: HIJSMM301CIQVS.11.28.C06.1.454.light.4.raw

SEQ ID NO: 567560 - DNA, 444 bp, Homo sapiens; identical to SEQ ID NO: 534993
  misc_feature: HIJSMM301DU7F0.5.9.A09.1.454.light.4.raw

SEQ ID NO: 567561 - DNA, 520 bp, Homo sapiens
  misc_feature: HIJSMM301DVR69.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtgttcggcggagggaccaggctgaccgtcctaggtcagcccaaggctgccccctcggtcactctgttcccgccct

SEQ ID NO: 567562 - DNA, 501 bp, Homo sapiens
  misc_feature: HIJSMM301AGUTB.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgtcggaccttcggccaagggacacgactggagattaaacgaactgtggctgcaccatctgtcttcatcttcccg

SEQ ID NO: 567563 - DNA, 493 bp, Homo sapiens; identical to SEQ ID NO: 535047
  misc_feature: HIJSMM301AOPIT.16.53.E09.1.454.light.4.raw

SEQ ID NO: 567564 - DNA, 495 bp, Homo sapiens
  misc_feature: HIJSMM301DL78T.8.81.H04.1.454.light.4.raw
ctcgcgtgtccacgaccggtgctcgatttagtagtgtagattcgcgggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggtaccaagctggagatcaaacgaactgtggctgcaccatctgtcttcta

SEQ ID NO: 567565 - DNA, 485 bp, Homo sapiens
  misc_feature: HIJSMM301AUBPT.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtgggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcacc

SEQ ID NO: 567566 - DNA, 503 bp, Homo sapiens
  misc_feature: HIJSMM301C9CIM.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaaggtggagatcaaacgaactgtggctgcaccatctgtcttcatcttccccg

SEQ ID NO: 567567 - DNA, 510 bp, Homo sapiens
  misc_feature: HIJSMM301AX4JZ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtctttactacttccgtcccacta

SEQ ID NO: 567568 - DNA, 488 bp, Homo sapiens; identical to SEQ ID NO: 535990
  misc_feature: HIJSMM301BRLZK.11.28.C06.1.454.light.4.raw

SEQ ID NO: 567569 - DNA, 498 bp, Homo sapiens
  misc_feature: HIJSMM301DH0JA.48.69.G03.1.454.light.4.raw
agtatacatacacgaccggtgctcgatttagtcgctgcgtaaaggagaaagggaaagggggagtcagacccagtcaggacacagcatggacatgagggtccccgctcagctcctggggctcctgctgctctggctcccaggtgccaaatgtgacatccagatgacccagtctccttccaccctgtctgcctctgtaggagacagggtcaccatcacttgccgggccagtcagagtattagtgactggttggcctggtatcagcagaaaccagggaaagcccctaacctcctgatctatcaggcatctactttagaagtggggtcccatcaaggttcagcggcagtggatctgaaacagaattcactctcaccatcagcagcctgcagcctgatgattatgcgacttattactgccaacaatacactagtttgtggacgttcggccaggggaccgaaggtggaaagtacaaacgaactagtggctgcaccatctgtctt

SEQ ID NO: 567570 - DNA, 500 bp, Homo sapiens
  misc_feature: HIJSMM301EFWNP.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttccc

SEQ ID NO: 567571 - DNA, 511 bp, Homo sapiens
  misc_feature: HIJSMM301DAJ51.5.58.F03.1.454.light.4.raw
  modified_base (447)..(447): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacactttttangttcgggactgggaccaaggtcaccgtcctaggtcagcccaaggccaacccactgtcactctcg

SEQ ID NO: 567572 - DNA, 521 bp, Homo sapiens; identical to SEQ ID NO: 538715
  misc_feature: HIJSMM301CCV5Z.27.23.C01.1.454.light.4.raw

SEQ ID NO: 567573 - DNA, 489 bp, Homo sapiens
  misc_feature: HIJSMM301AYPUT.5.6.A06.1.454.light.4.raw
atcagacacgcacgaccggtgctcgatttagatctactgacagggggcaggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaactttactattgtcagcaggctaggaggacgccgtgggacgttcggtccaagggaccgaaggtggaaatacaaacgaaactgtggctgcaccatct

SEQ ID NO: 567574 - DNA, 487 bp, Homo sapiens; identical to SEQ ID NO: 538190
  misc_feature: HIJSMM301A5UDN.47.70.G04.1.454.light.4.raw

SEQ ID NO: 567575 - DNA, 502 bp, Homo sapiens
  misc_feature: HIJSMM301BJC0F.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcaacagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacggaactgtggctgcaccatctgtcttcatcttccccg

SEQ ID NO: 567576 - DNA, 510 bp, Homo sapiens
  misc_feature: HIJSMM301AXGUW.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgattaatttctgggttgttcggcggagggaccaaactcgaccgtcctaggtcagcccaaggctcgccccctcggtcactc

SEQ ID NO: 567577 - DNA, 517 bp, Homo sapiens; identical to SEQ ID NO: 541775
  misc_feature: HIJSMM301EQPL2.5.27.C05.1.454.light.4.raw

SEQ ID NO: 567578 - DNA, 487 bp, Homo sapiens
  misc_feature: HIJSMM301C1LQ6.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgctagtttattactgtcagcagtataataactggcctccgtacatgtacacttttggccaggggaccaaccgtggagat

SEQ ID NO: 567579 - DNA, 486 bp, Homo sapiens
  misc_feature: HIJSMM301DTSTI.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccc

SEQ ID NO: 567580 - DNA, 513 bp, Homo sapiens
  misc_feature: HIJSMM301BVQGF.53.66.F11.1.454.light.4.raw
cgcgtatacacacgaccggtgctcgatttagtcacgcgagaaggggctgggcctaaggaagcagcactggtggtgcctcagccatggcctggaccgttctcctcctcggcctcctctctcactgcacagtctctgtgacctcctatgtgctgactcagccaccctcggtgtcagtggccccaggaaagacggccgcgattacctgtgggggacacaacattggaactaaacgtgtgcactggtaccagcagatgcccggccaggcccctgttgtcgtctattatgatgtcgaccggccctcagggatccctgagcgattctctggctccacctctgggaacacggccaccctgaccatcagccgggtcgaggccggggatgaggccgactatttctgtcaaatctgggacagtaattttgacattccggtcttcggcggagggaccaagctgaccgtcctaggtcagcccaaggctgccccctcggtcactctgttcccgccctcctctcgta

SEQ ID NO: 567581 - DNA, 482 bp, Homo sapiens; identical to SEQ ID NO: 535920
  misc_feature: HIJSMM301BGQXA.19.71.G05.1.454.light.4.raw

SEQ ID NO: 567582 - DNA, 482 bp, Homo sapiens
  misc_feature: HIJSMM301EWB90.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttaacacctggcctggaagttttggcagggaccaagctggagctcaaacgaactgtggctgcacat

SEQ ID NO: 567583 - DNA, 508 bp, Homo sapiens
  misc_feature: HIJSMM301AKO5B.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtcgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaaggctcgtccccccg

SEQ ID NO: 567584 - DNA, 499 bp, Homo sapiens
  misc_feature: HIJSMM301BCYKA.26.72.G06.1.454.light.4.raw
agactatactcacgaccggtgctcgatttagctacgactgcaaggggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggcctaggggacccaggtggaggatcagacgaactgtggctgcaccatctgtcttcatcttcccgt

SEQ ID NO: 567585 - DNA, 489 bp, Homo sapiens; identical to SEQ ID NO: 542780
  misc_feature: HIJSMM301D45PE.16.53.E09.1.454.light.4.raw

SEQ ID NO: 567586 - DNA, 486 bp, Homo sapiens; identical to SEQ ID NO: 537144
  misc_feature: HIJSMM301EA61W.46.35.D02.1.454.light.4.raw

SEQ ID NO: 567587 - DNA, 497 bp, Homo sapiens
  misc_feature: HIJSMM301EDJ96.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgaccgttcggccaagggaccaaggtggaagtcagacgaactgtggctgcaccatctgtcttcat

SEQ ID NO: 567588 - DNA, 495 bp, Homo sapiens
  misc_feature: HIJSMM301BLI42.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccagggggacacgactggagattaagcgaactgtggctgcaccatctgtctt

SEQ ID NO: 567589 - DNA, 501 bp, Homo sapiens
  misc_feature: HIJSMM301B9RMS.49.30.C08.1.454.light.4.raw
agtcgagagacacgaccggtgctcgatttagtctgacgtcaaagggaaagggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcac

SEQ ID NO: 567590 - DNA, 447 bp, Homo sapiens; identical to SEQ ID NO: 535201
  misc_feature: HIJSMM301A9V8H.18.9.A09.1.454.light.4.raw

SEQ ID NO: 567591 - DNA, 503 bp, Homo sapiens; identical to SEQ ID NO: 538973
  misc_feature: HIJSMM301BBILI.5.86.H09.1.454.light.4.raw

SEQ ID NO: 567592 - DNA, 495 bp, Homo sapiens
  misc_feature: HIJSMM301A3CJF.10.79.H02.1.454.light.4.raw
catagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaaactgtggctgcaccatctgtctt

SEQ ID NO: 567593 - DNA, 504 bp, Homo sapiens; identical to SEQ ID NO: 539690
  misc_feature: HIJSMM301BBH2X.47.65.F10.1.454.light.4.raw

SEQ ID NO: 567594 - DNA, 515 bp, Homo sapiens
  misc_feature: HIJSMM301AZR7S.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaacggtaggaagtacgaaacgaactacgtggcgtgcaccactctgtcttctactcttcccgtccact

SEQ ID NO: 567595 - DNA, 490 bp, Homo sapiens
  misc_feature: HIJSMM301CKWFT.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtaagaaatacaaacgaactgtggctgcaccatctgtt

SEQ ID NO: 567596 - DNA, 444 bp, Homo sapiens; identical to SEQ ID NO: 535192
  misc_feature: HIJSMM301BL9OV.5.9.A09.1.454.light.4.raw

SEQ ID NO: 567597 - DNA, 485 bp, Homo sapiens; identical to SEQ ID NO: 547492
  misc_feature: HIJSMM301A5GYG.10.28.C06.1.454.light.4.raw

SEQ ID NO: 567598 - DNA, 492 bp, Homo sapiens; identical to SEQ ID NO: 537666
  misc_feature: HIJSMM301C1BX5.43.33.C11.1.454.light.4.raw

SEQ ID NO: 567599 - DNA, 519 bp, Homo sapiens
  misc_feature: HIJSMM301D3D5J.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctggtggggcaggtcacgcccaaggcccaacccccactcggtcaccttccg

SEQ ID NO: 567600 - DNA, 497 bp, Homo sapiens; identical to SEQ ID NO: 535740
  misc_feature: HIJSMM301DAKRT.3.71.G05.1.454.light.4.raw

SEQ ID NO: 567601 - DNA, 466 bp, Homo sapiens; identical to SEQ ID NO: 541765
  misc_feature: HIJSMM301APB5C.11.70.G04.1.454.light.4.raw

SEQ ID NO: 567602 - DNA, 510 bp, Homo sapiens
  misc_feature: HIJSMM301BU7BO.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgatttattactgcagctcatattcaggcagcaacagggtattcggcggagggaccaagttgaccgtcctaggtcagcccaaggctgccccctcggtcactctcgttcccaccct

SEQ ID NO: 567603 - DNA, 503 bp, Homo sapiens; identical to SEQ ID NO: 538583
  misc_feature: HIJSMM301CHISG.15.59.F04.1.454.light.4.raw

SEQ ID NO: 567604 - DNA, 510 bp, Homo sapiens
  misc_feature: HIJSMM301EH6YH.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgacctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccg

SEQ ID NO: 567605 - DNA, 476 bp, Homo sapiens
  misc_feature: HIJSMM301CG742.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 567606 - DNA, 486 bp, Homo sapiens
  misc_feature: HIJSMM301ARWYC.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgatccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacc

SEQ ID NO: 567607 - DNA, 489 bp, Homo sapiens; identical to SEQ ID NO: 535139
  misc_feature: HIJSMM301AL9W2.14.55.E11.1.454.light.4.raw

SEQ ID NO: 567608 - DNA, 480 bp, Homo sapiens; identical to SEQ ID NO: 535291
  misc_feature: HIJSMM301BHEYZ.22.59.F04.1.454.light.4.raw

SEQ ID NO: 567609 - DNA, 489 bp, Homo sapiens; identical to SEQ ID NO: 535139
  misc_feature: HIJSMM301AKKKW.14.55.E11.1.454.light.4.raw

SEQ ID NO: 567610 - DNA, 491 bp, Homo sapiens
  misc_feature: HIJSMM301CWO8R.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggaggaccaaggtggagatcaaacgaactgtggc

SEQ ID NO: 567611 - DNA, 485 bp, Homo sapiens; identical to SEQ ID NO: 543180
  misc_feature: HIJSMM301EXQX0.3.10.A10.1.454.light.4.raw

SEQ ID NO: 567612 - DNA, 487 bp, Homo sapiens
  misc_feature: HIJSMM301ERL94.53.55.E11.1.454.light.4.raw
cgcgtatacacacgaccggtgctcgatttagcactcgcacgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctccgg

SEQ ID NO: 567613 - DNA, 483 bp, Homo sapiens
  misc_feature: HIJSMM301CKXLY.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaacggtggaaatcaaacgactgtggctgcaccatctgtctt

SEQ ID NO: 567614 - DNA, 495 bp, Homo sapiens
  misc_feature: HIJSMM301CAJTL.27.78.H01.1.454.light.4.raw
  modified_base (475)..(475): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactgggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaacngtggctgcaccatctgtctt

SEQ ID NO: 567615 - DNA, 511 bp, Homo sapiens
  misc_feature: HIJSMM301A61XY.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaacccactgtcactctcg

SEQ ID NO: 567616 - DNA, 444 bp, Homo sapiens; identical to SEQ ID NO: 534993
  misc_feature: HIJSMM301BHIVB.5.9.A09.1.454.light.4.raw

SEQ ID NO: 567617 - DNA, 508 bp, Homo sapiens; identical to SEQ ID NO: 550380
  misc_feature: HIJSMM301EFY84.4.57.F02.1.454.light.4.raw

SEQ ID NO: 567618 - DNA, 504 bp, Homo sapiens
  misc_feature: HIJSMM301BSM9T.22.57.F02.1.454.light.4.raw
  modified_base (425)..(425): a, c, t, g, unknown or other
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaatctactntcaccgactatacttattacgttcgtaccttccggtccgaacggaacgacgacctaggacgagtaaacgtaactaacgt

SEQ ID NO: 567619 - DNA, 422 bp, Homo sapiens; identical to SEQ ID NO: 447881
  misc_feature: HIJSMM301DNY43.9.34.D01.1.454.light.4.raw

SEQ ID NO: 567620 - DNA, 474 bp, Homo sapiens
  misc_feature: HIJSMM301DTRGL.12.38.D05.1.454.light.4.raw
  modified_base (419)..(419): a, c, t, g, unknown or other
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatganaagtggttcaagactttgcggagggaccgaaggtaggaggatacaacaaacaagt

SEQ ID NO: 567621 - DNA, 484 bp, Homo sapiens
  misc_feature: HIJSMM301EEXSJ.46.35.D02.1.454.light.4.raw
actagcagtacacgaccggtgctcgatttagcacacgatagttggatttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacc

SEQ ID NO: 567622 - DNA, 493 bp, Homo sapiens; identical to SEQ ID NO: 549803
  misc_feature: HIJSMM301EARKZ.13.56.F01.1.454.light.4.raw

SEQ ID NO: 567623 - DNA, 495 bp, Homo sapiens; identical to SEQ ID NO: 537780
  misc_feature: HIJSMM301C03P7.5.24.C02.1.454.light.4.raw

SEQ ID NO: 567624 - DNA, 486 bp, Homo sapiens
  misc_feature: HIJSMM301DM09G.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacgtaccccgtacacttttggccagggaccaaactggacatcaaacgaactgtggctgcaccatctgtt

SEQ ID NO: 567625 - DNA, 487 bp, Homo sapiens; identical to SEQ ID NO: 536025
  misc_feature: HIJSMM301CU7IP.17.34.D01.1.454.light.4.raw

SEQ ID NO: 567626 - DNA, 493 bp, Homo sapiens; identical to SEQ ID NO: 535657
  misc_feature: HIJSMM301CNQG8.27.78.H01.1.454.light.4.raw

SEQ ID NO: 567627 - DNA, 498 bp, Homo sapiens
  misc_feature: HIJSMM301CZNXO.16.67.G01.1.454.light.4.raw
tgtactactccacgaccggtgctcgatttagagtatacatattgggtttgggggtagctcaggaagcagagcctggagcatctccactatggcctgggctccactacttctcaccctcctcgctcactgcacaggttcttgggccaattttacgctgactcagccccactctgtgtcggagtctccggggaagacggtgaccatctcctgcacccgcagcagtggcagcattgccaggaactttgtgcagtggttccagcagcgcccgggcagtgcccccaccagtgtgatctatgaagataatcaaaggccctctggggtccctgatcgcttctctggctccatcgacacctcctccaactcagcctccctcaccatctctggagtgaagcctgaggacgaggctgactactactgtcagtctttaatgacaccgttgtgatattcggcggaggaccaagctgaccgtcctaggtcagcccaaggctgccccctggt

SEQ ID NO: 567628 - DNA, 383 bp, Homo sapiens; identical to SEQ ID NO: 447524
  misc_feature: HIJSMM301BNXDW.41.26.C04.1.454.light.4.raw

SEQ ID NO: 567629 - DNA, 502 bp, Homo sapiens
  misc_feature: HIJSMM301BGI5Q.14.53.E09.1.454.light.4.raw
cgtctagtaccacgaccggtgctcgatttagagagagtgtgttgggtttggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggcgtgactattattgtacaatcagcagtcagcactaattcttagtcgggttgttcggcggaggaccaagctcgtaccgtccgtaggtcacgccgaaggctcgcccccgtcggta

SEQ ID NO: 567630 - DNA, 511 bp, Homo sapiens
  misc_feature: HIJSMM301CPMPH.9.43.D10.1.454.light.4.raw
tgatacgtctcacgaccggtgctcgatttagactagcagtaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggagaccctcaggggtccctgatcgcttctctggctccaagtctgccaacacggcctccctgaccgtctctgggctccaggctgaggatgaggctgattattattgcagctcatattcaggcagtaacagggttttcgggcggagggaccaagactgaccgtcctagatcagcccaaggctgccccctcggtcactctgttcccaccctcct

SEQ ID NO: 567631 - DNA, 473 bp, Homo sapiens
  misc_feature: HIJSMM301B94ZG.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctcctgaccatctctgggctccaggctgaggacgaggctgactattattgcagttcatatggtagtatgaagactcttgtgattttcggcggagggaccaagctgaccgt

SEQ ID NO: 567632 - DNA, 488 bp, Homo sapiens
  misc_feature: HIJSMM301EYWF2.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggtcggtttattattgtcaacaattattttagtgctccgtacacttttggccaggggaccaagttggagatcaaacgaa

SEQ ID NO: 567633 - DNA, 494 bp, Homo sapiens; identical to SEQ ID NO: 535090
  misc_feature: HIJSMM301ECYU3.27.78.H01.1.454.light.4.raw
  modified_base (403)..(403): a, c, t, g, unknown or other

SEQ ID NO: 567634 - DNA, 445 bp, Homo sapiens
  misc_feature: HIJSMM301CZ2G6.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagcccaaggccaaccctctgtcactctgttcccaccctcctccatactcgta

SEQ ID NO: 567635 - DNA, 489 bp, Homo sapiens
  misc_feature: HIJSMM301CRIYT.43.34.D01.1.454.light.4.raw
tgtgagtagtcacgaccggtgctcgatttagatcgtctgtgttgggtttgggggaagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcggccaagggaccaaggtggaaatcaaacgaactgtggctgcaccat

SEQ ID NO: 567636 - DNA, 508 bp, Homo sapiens
  misc_feature: HIJSMM301CD8ZX.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccgaagactgaccgtcctaggtcagcccaacggctgtcccccg

SEQ ID NO: 567637 - DNA, 494 bp, Homo sapiens
  misc_feature: HIJSMM301DNDSV.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggaggggaccaaggtggagatcaaacgaactgtggctgcaccatctgtctttca

SEQ ID NO: 567638 - DNA, 464 bp, Homo sapiens
  misc_feature: HIJSMM301AFFEZ.4.59.F04.1.454.light.4.raw
agcactgtagcacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggcggagggaccaaggtggagatcaagagaa

SEQ ID NO: 567639 - DNA, 516 bp, Homo sapiens
  misc_feature: HIJSMM301CF3XM.52.57.F02.1.454.light.4.raw
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacatttgggggtttcggcggagggaccaaggtgaccgtctacgtcagcccaaggctgccccctcggtcactctgtcccc

SEQ ID NO: 567640 - DNA, 502 bp, Homo sapiens; identical to SEQ ID NO: 536253
  misc_feature: HIJSMM301D7107.21.22.B11.1.454.light.4.raw

SEQ ID NO: 567641 - DNA, 514 bp, Homo sapiens
  misc_feature: HIJSMM301AMM6T.16.66.F11.1.454.light.4.raw
  modified_base (253)..(253): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggnagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 567642 - DNA, 498 bp, Homo sapiens
  misc_feature: HIJSMM301A167D.9.1.A01.1.454.light.4.raw
tgatacgtctcacgaccggtgctcgatttagacgtctcatcaggggggagctgctcagttaggacccagagggaaccatcggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttctatcttccccg

SEQ ID NO: 567643 - DNA, 493 bp, Homo sapiens; identical to SEQ ID NO: 547772
  misc_feature: HIJSMM301D63C0.47.64.F09.1.454.light.4.raw

SEQ ID NO: 567644 - DNA, 520 bp, Homo sapiens; identical to SEQ ID NO: 555934
  misc_feature: HIJSMM301ECVU3.5.27.C05.1.454.light.4.raw

SEQ ID NO: 567645 - DNA, 510 bp, Homo sapiens
  misc_feature: HIJSMM301CR6NM.41.30.C08.1.454.light.4.raw
  modified_base (484)..(484): a, c, t, g, unknown or other
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaacgtacatcatttattgatgtcggtagtcggccctccgggtcgtctagtcgcttctctggctccaagtctggcaacacggcctccctcgaccatctctggcgtccaggctgaggacgaggctgattattactgcagctcatatacaagacagcagcactctccgtggtgttcggtcggagggaccgaagaccgtnaccgtacctacggtcgagcccaacgg

SEQ ID NO: 567646 - DNA, 499 bp, Homo sapiens
  misc_feature: HIJSMM301A4RL8.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 567647 - DNA, 489 bp, Homo sapiens; identical to SEQ ID NO: 535139
  misc_feature: HIJSMM301C20C6.14.55.E11.1.454.light.4.raw

SEQ ID NO: 567648 - DNA, 516 bp, Homo sapiens
  misc_feature: HIJSMM301AIDXG.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgtcccacctcctccacg

SEQ ID NO: 567649 - DNA, 505 bp, Homo sapiens; identical to SEQ ID NO: 535503
  misc_feature: HIJSMM301ALESO.8.28.C06.1.454.light.4.raw

SEQ ID NO: 567650 - DNA, 490 bp, Homo sapiens; identical to SEQ ID NO: 541974
  misc_feature: HIJSMM301AXLCK.22.65.F10.1.454.light.4.raw

SEQ ID NO: 567651 - DNA, 494 bp, Homo sapiens
  misc_feature: HIJSMM301BYA1B.51.55.E11.1.454.light.4.raw
cgatcgtatacacgaccggtgctcgatttagcactcgcacgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 567652 - DNA, 354 bp, Homo sapiens; identical to SEQ ID NO: 535026
  misc_feature: HIJSMM301CT5M8.19.22.B11.1.454.light.4.raw

SEQ ID NO: 567653 - DNA, 482 bp, Homo sapiens
  misc_feature: HIJSMM301B17QY.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaaggctgaccgtccctaagtcagaccccg

SEQ ID NO: 567654 - DNA, 441 bp, Homo sapiens; identical to SEQ ID NO: 534971
  misc_feature: HIJSMM301B8QU3.11.3.A03.1.454.light.4.raw

SEQ ID NO: 567655 - DNA, 484 bp, Homo sapiens; identical to SEQ ID NO: 535240
  misc_feature: HIJSMM301CMGTY.47.60.F05.1.454.light.4.raw

SEQ ID NO: 567656 - DNA, 513 bp, Homo sapiens
  misc_feature: HIJSMM301BZ195.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccccactgtcactctcg

SEQ ID NO: 567657 - DNA, 469 bp, Homo sapiens; identical to SEQ ID NO: 545689
  misc_feature: HIJSMM301EG7Q3.13.76.G10.1.454.light.4.raw

SEQ ID NO: 567658 - DNA, 495 bp, Homo sapiens; identical to SEQ ID NO: 545183
  misc_feature: HIJSMM301AJPGJ.16.10.A10.1.454.light.4.raw

SEQ ID NO: 567659 - DNA, 504 bp, Homo sapiens; identical to SEQ ID NO: 547380
  misc_feature: HIJSMM301D7YH4.9.12.B01.1.454.light.4.raw

SEQ ID NO: 567660 - DNA, 483 bp, Homo sapiens; identical to SEQ ID NO: 535413
  misc_feature: HIJSMM301EOT89.26.78.H01.1.454.light.4.raw

SEQ ID NO: 567661 - DNA, 474 bp, Homo sapiens; identical to SEQ ID NO: 544751
  misc_feature: HIJSMM301B096B.3.38.D05.1.454.light.4.raw

SEQ ID NO: 567662 - DNA, 505 bp, Homo sapiens; identical to SEQ ID NO: 537876
  misc_feature: HIJSMM301B7SRF.5.68.G02.1.454.light.4.raw

SEQ ID NO: 567663 - DNA, 440 bp, Homo sapiens; identical to SEQ ID NO: 537628
  misc_feature: HIJSMM301BNSZ8.41.9.A09.1.454.light.4.raw

SEQ ID NO: 567664 - DNA, 521 bp, Homo sapiens; identical to SEQ ID NO: 539470
  misc_feature: HIJSMM301A83NR.27.23.C01.1.454.light.4.raw

SEQ ID NO: 567665 - DNA, 497 bp, Homo sapiens; identical to SEQ ID NO: 536371
  misc_feature: HIJSMM301D8QTQ.16.78.H01.1.454.light.4.raw

SEQ ID NO: 567666 - DNA, 485 bp, Homo sapiens
  misc_feature: HIJSMM301C8F7O.49.7.A07.1.454.light.4.raw
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatgggggcgagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggcctgccccctcggtcactctcgttcccaccctcctctctctcgact

SEQ ID NO: 567667 - DNA, 480 bp, Homo sapiens
  misc_feature: HIJSMM301D7U58.43.87.H10.1.454.light.4.raw
tgtgagtagtcacgaccggtgctcgatttagcagtactgcgttgggtttggggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggt

SEQ ID NO: 567668 - DNA, 503 bp, Homo sapiens; identical to SEQ ID NO: 540136
  misc_feature: HIJSMM301A5JTY.19.10.A10.1.454.light.4.raw

SEQ ID NO: 567669 - DNA, 513 bp, Homo sapiens; identical to SEQ ID NO: 535719
  misc_feature: HIJSMM301CMXPQ.17.33.C11.1.454.light.4.raw

SEQ ID NO: 567670 - DNA, 521 bp, Homo sapiens; identical to SEQ ID NO: 539470
  misc_feature: HIJSMM301AHVJ6.27.23.C01.1.454.light.4.raw

SEQ ID NO: 567671 - DNA, 481 bp, Homo sapiens; identical to SEQ ID NO: 545917
  misc_feature: HIJSMM301AG1WS.52.5.A05.1.454.light.4.raw

SEQ ID NO: 567672 - DNA, 504 bp, Homo sapiens; identical to SEQ ID NO: 536385
  misc_feature: HIJSMM301BT0SU.27.78.H01.1.454.light.4.raw

SEQ ID NO: 567673 - DNA, 494 bp, Homo sapiens
  misc_feature: HIJSMM301B10P1.27.78.H01.1.454.light.4.raw
agcgtcgtctcacgaccggtgctcgatttagtgtgagtagtttgggtttggggatgagacaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtgctgcaccatctgtctt

SEQ ID NO: 567674 - DNA, 491 bp, Homo sapiens
  misc_feature: HIJSMM301DVZVZ.47.55.E11.1.454.light.4.raw
  modified_base (473)..(473): a, c, t, g, unknown or other
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccnccctcctctacgtgagct

SEQ ID NO: 567675 - DNA, 499 bp, Homo sapiens
  misc_feature: HIJSMM301CT0JE.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgcccctccggtcactctgttcccaccctcctccactactatg

SEQ ID NO: 567676 - DNA, 447 bp, Homo sapiens; identical to SEQ ID NO: 535201
  misc_feature: HIJSMM301CSL6J.18.9.A09.1.454.light.4.raw

SEQ ID NO: 567677 - DNA, 491 bp, Homo sapiens; identical to SEQ ID NO: 550951
  misc_feature: HIJSMM301ETDW1.17.21.B10.1.454.light.4.raw

SEQ ID NO: 567678 - DNA, 504 bp, Homo sapiens
  misc_feature: HIJSMM301D1ABW.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 567679 - DNA, 494 bp, Homo sapiens; identical to SEQ ID NO: 534994
  misc_feature: HIJSMM301A7OPL.27.78.H01.1.454.light.4.raw

SEQ ID NO: 567680 - DNA, 484 bp, Homo sapiens; identical to SEQ ID NO: 535400
  misc_feature: HIJSMM301ARJ6U.46.26.C04.1.454.light.4.raw

SEQ ID NO: 567681 - DNA, 486 bp, Homo sapiens; identical to SEQ ID NO: 536329
  misc_feature: HIJSMM301B2GER.21.4.A04.1.454.light.4.raw

SEQ ID NO: 567682 - DNA, 501 bp, Homo sapiens; identical to SEQ ID NO: 536867
  misc_feature: HIJSMM301D1QTG.5.86.H09.1.454.light.4.raw

SEQ ID NO: 567683 - DNA, 504 bp, Homo sapiens; identical to SEQ ID NO: 542411
  misc_feature: HIJSMM301BAGTM.9.53.E09.1.454.light.4.raw

SEQ ID NO: 567684 - DNA, 488 bp, Homo sapiens
  misc_feature: HIJSMM301CL3E2.47.67.G01.1.454.light.4.raw
agctcacgtacacgaccggtgctcgatttagagtatacatattgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctactacttttggccaggggaccaagctggagatcaaacgaa

SEQ ID NO: 567685 - DNA, 485 bp, Homo sapiens; identical to SEQ ID NO: 544293
  misc_feature: HIJSMM301D9K0Y.26.70.G04.1.454.light.4.raw

SEQ ID NO: 567686 - DNA, 493 bp, Homo sapiens
  misc_feature: HIJSMM301E1UQ7.43.29.C07.1.454.light.4.raw
tgtgagtagtcacgaccggtgctcgatttagagtgctacgaagggaaaggggacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactagtggctgcaccatctgtcttcatcttcccgccatctgaacta

SEQ ID NO: 567687 - DNA, 494 bp, Homo sapiens; identical to SEQ ID NO: 534992
  misc_feature: HIJSMM301BOG7R.9.1.A01.1.454.light.4.raw

SEQ ID NO: 567688 - DNA, 473 bp, Homo sapiens; identical to SEQ ID NO: 535262
  misc_feature: HIJSMM301EVYSR.8.67.G01.1.454.light.4.raw

SEQ ID NO: 567689 - DNA, 524 bp, Homo sapiens
  misc_feature: HIJSMM301CGVU6.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaagctgccctgaccctaacggggcgcagcctgaggacgaggccgactattattgcctactatcatttgatggtggtcgtctgcccattttcggcggcgggaccagggtggccgtcctgggtcagcccaaggctgccccctcggtcactctgttcccaccctcctcctagtctacg

SEQ ID NO: 567690 - DNA, 504 bp, Homo sapiens
  misc_feature: HIJSMM301BIKE0.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtacaaacgaactgtggctgcaccatctgtcttcatt

SEQ ID NO: 567691 - DNA, 492 bp, Homo sapiens
  misc_feature: HIJSMM301EEH4V.10.5.A05.1.454.light.4.raw
catagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaggaatgtttagcttggtaccagcagaaaccaggacagtctcctaagctgctcatttactgggcatcgacccgggaatccggggtccctgaccgattcagtggcagcgggtctgggacagaattcactctcaccatcaacagcctgcaggctgaagatgtggcagtttatttctgtcaacagtatctttcttctccgtggacgttcggccaagggaccaaggtggaactcaaacgaactgtggctgcaccat

SEQ ID NO: 567692 - DNA, 494 bp, Homo sapiens
  misc_feature: HIJSMM301CGL0P.51.81.H04.1.454.light.4.raw
cgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 567693 - DNA, 504 bp, Homo sapiens
  misc_feature: HIJSMM301DX37E.48.38.D05.1.454.light.4.raw
agtatacatacacgaccggtgctcgatttagtatctgatagttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 567694 - DNA, 481 bp, Homo sapiens; identical to SEQ ID NO: 535993
  misc_feature: HIJSMM301B8JUH.21.25.C03.1.454.light.4.raw

SEQ ID NO: 567695 - DNA, 494 bp, Homo sapiens; identical to SEQ ID NO: 534992
  misc_feature: HIJSMM301CJJPS.9.1.A01.1.454.light.4.raw

SEQ ID NO: 567696 - DNA, 416 bp, Homo sapiens; identical to SEQ ID NO: 539343
  misc_feature: HIJSMM301DRRUL.18.78.H01.1.454.light.4.raw

SEQ ID NO: 567697 - DNA, 509 bp, Homo sapiens
  misc_feature: HIJSMM301EYXVC.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtggaccgaaggtggagatcaaacgaactgtggctgcaccatctgtcttcta

SEQ ID NO: 567698 - DNA, 493 bp, Homo sapiens; identical to SEQ ID NO: 543205
  misc_feature: HIJSMM301D477T.51.6.A06.1.454.light.4.raw

SEQ ID NO: 567699 - DNA, 491 bp, Homo sapiens
  misc_feature: HIJSMM301ENAJV.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgca

SEQ ID NO: 567700 - DNA, 478 bp, Homo sapiens
  misc_feature: HIJSMM301EWGFX.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttgctgttcggcgcgggacc

SEQ ID NO: 567701 - DNA, 444 bp, Homo sapiens; identical to SEQ ID NO: 535594
  misc_feature: HIJSMM301DD831.9.9.A09.1.454.light.4.raw

SEQ ID NO: 567702 - DNA, 482 bp, Homo sapiens
  misc_feature: HIJSMM301BWDA4.4.39.D06.1.454.light.4.raw
agcactgtagcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagcccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcacc

SEQ ID NO: 567703 - DNA, 513 bp, Homo sapiens
  misc_feature: HIJSMM301EKUW2.53.66.F11.1.454.light.4.raw
cgcgtatacacacgaccggtgctcgatttagtcacgcgagaaggggctgggcctaaggaagcagcactggtggtgcctcagccatggcctggaccgttctcctcctcggcctcctctctcactgcacagtctctgtgacctcctatgtgctgactcagccaccctcggtgtcagtggccccaggaaagacggccgcgattacctgtgggggacacaacattggaactaaacgtgtgcactggtaccagcagatgcccggccaggcccctgttgtcgtctattatgatgtcgaccggccctcagggatccctgagcgattctctggctccacctctgggaacacggccaccctgaccatcagccgggtcgaggccggggatgaggccgactatttctgtcaaatctgggacagtaattttgacattccggtcttcggcggagggaccaagctgaccgtcctaggtcagcccaaggctgccccctcggtcactctgttcccaccctcctctcgta

SEQ ID NO: 567704 - DNA, 490 bp, Homo sapiens
  misc_feature: HIJSMM301BJMVE.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtcctccccttagtttcggcgggaggaccgaaggttgagatacaaacgaactgtggctgcaccatctgtcttcatt

SEQ ID NO: 567705 - DNA, 478 bp, Homo sapiens
  misc_feature: HIJSMM301AFMBP.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaactcactttcggccctcgggactgaagtgcatatgaagagaactgtggctgca

SEQ ID NO: 567706 - DNA, 444 bp, Homo sapiens; identical to SEQ ID NO: 535192
  misc_feature: HIJSMM301AWVAV.5.9.A09.1.454.light.4.raw

SEQ ID NO: 567707 - DNA, 491 bp, Homo sapiens
  misc_feature: HIJSMM301EAORV.41.23.C01.1.454.light.4.raw
tctatactatcacgaccggtgctcgatttagtacacgtgattagggattggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctc

SEQ ID NO: 567708 - DNA, 503 bp, Homo sapiens
  misc_feature: HIJSMM301CTIYE.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtcta

SEQ ID NO: 567709 - DNA, 502 bp, Homo sapiens
  misc_feature: HIJSMM301DE1KO.41.35.D02.1.454.light.4.raw
tctatactatcacgaccggtgctcgatttagcacacgatagttcgggtttcgggggggtctcaggaggcagcgctctcggggacgtctccaaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactctcgtggtattcggcggagggaccaagctgaccgtcctaggtcagcccaaggctcg

SEQ ID NO: 567710 - DNA, 507 bp, Homo sapiens; identical to SEQ ID NO: 563344
  misc_feature: HIJSMM301CL9TB.3.79.H02.1.454.light.4.raw

SEQ ID NO: 567711 - DNA, 484 bp, Homo sapiens; identical to SEQ ID NO: 550343
  misc_feature: HIJSMM301BOC4W.40.81.H04.1.454.light.4.raw

SEQ ID NO: 567712 - DNA, 506 bp, Homo sapiens
  misc_feature: HIJSMM301C7PZ2.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctactaattacgttcgagggaccggaacttagtaacaatacaatagaacctagtggtcgtgcacccaactctgtctt

SEQ ID NO: 567713 - DNA, 495 bp, Homo sapiens; identical to SEQ ID NO: 538269
  misc_feature: HIJSMM301BC22R.9.1.A01.1.454.light.4.raw

SEQ ID NO: 567714 - DNA, 490 bp, Homo sapiens; identical to SEQ ID NO: 535234
  misc_feature: HIJSMM301DVFKO.17.21.B10.1.454.light.4.raw

SEQ ID NO: 567715 - DNA, 485 bp, Homo sapiens
  misc_feature: HIJSMM301C2YRF.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggtccaggggacccaggctggaggatcagacgaacctgt

SEQ ID NO: 567716 - DNA, 487 bp, Homo sapiens
  misc_feature: HIJSMM301CLGVV.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatacagacgaa

SEQ ID NO: 567717 - DNA, 484 bp, Homo sapiens
  misc_feature: HIJSMM301ETV4H.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattatatacttcgtggacgttcggccaagggaccaaggtggatatcagacgaa

SEQ ID NO: 567718 - DNA, 498 bp, Homo sapiens
  misc_feature: HIJSMM301D2ZZ5.3.37.D04.1.454.light.4.raw
agacgcactccacgaccggtgctcgatttagtagcatactgttgggtttggggaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttatactgcgtgcaagttcgacaaaccccattcactttcggccctgggaccaaagtggacatcaaacgaactgtggctgcaccatctgtcttc

SEQ ID NO: 567719 - DNA, 473 bp, Homo sapiens
  misc_feature: HIJSMM301C5IS6.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagtaacg

SEQ ID NO: 567720 - DNA, 501 bp, Homo sapiens
  misc_feature: HIJSMM301ENIKK.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggtcggagggaccaaggtggagatcaaacgaactgtggctgcaccta

SEQ ID NO: 567721 - DNA, 494 bp, Homo sapiens; identical to SEQ ID NO: 534992
  misc_feature: HIJSMM301BJMXV.9.1.A01.1.454.light.4.raw

SEQ ID NO: 567722 - DNA, 483 bp, Homo sapiens; identical to SEQ ID NO: 538138
  misc_feature: HIJSMM301B5H9M.41.34.D01.1.454.light.4.raw

SEQ ID NO: 567723 - DNA, 494 bp, Homo sapiens; identical to SEQ ID NO: 534992
  misc_feature: HIJSMM301BWUU2.9.1.A01.1.454.light.4.raw

SEQ ID NO: 567724 - DNA, 515 bp, Homo sapiens; identical to SEQ ID NO: 539211
  misc_feature: HIJSMM301E0M50.22.28.C06.1.454.light.4.raw

SEQ ID NO: 567725 - DNA, 496 bp, Homo sapiens
  misc_feature: HIJSMM301DNWHG.49.66.F11.1.454.light.4.raw
agtcgagagacacgaccggtgctcgatttagtcacgcgagaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgctagtttattactgtcaacagcgtaccacaggattcactttcggccctgggaccagagtggatatacaaacgaactgtggctgcaccatctgtcttcatcttcccg

SEQ ID NO: 567726 - DNA, 502 bp, Homo sapiens; identical to SEQ ID NO: 536253
  misc_feature: HIJSMM301C6UZL.21.22.B11.1.454.light.4.raw

SEQ ID NO: 567727 - DNA, 506 bp, Homo sapiens
  misc_feature: HIJSMM301A44E7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccatctgtcttctatctttccccg

SEQ ID NO: 567728 - DNA, 487 bp, Homo sapiens
  misc_feature: HIJSMM301D9FBQ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcactatcagcagcctgcagtctgaagattgtgcaatttattactgtcagcaatataatacctggcctccgctcactttcggcggagggaccaaggttgagatcaaacgaactgtggctgcacc

SEQ ID NO: 567729 - DNA, 497 bp, Homo sapiens; identical to SEQ ID NO: 545672
  misc_feature: HIJSMM301AVIGS.2.49.E05.1.454.light.4.raw

SEQ ID NO: 567730 - DNA, 404 bp, Homo sapiens; identical to SEQ ID NO: 535530
  misc_feature: HIJSMM301AI44G.4.35.D02.1.454.light.4.raw

SEQ ID NO: 567731 - DNA, 503 bp, Homo sapiens
  misc_feature: HIJSMM301C8PJ5.48.37.D04.1.454.light.4.raw
  modified_base (237)..(237): a, c, t, g, unknown or other
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 567732 - DNA, 479 bp, Homo sapiens; identical to SEQ ID NO: 535188
  misc_feature: HIJSMM301DCAT8.10.74.G08.1.454.light.4.raw

SEQ ID NO: 567733 - DNA, 486 bp, Homo sapiens; identical to SEQ ID NO: 535043
  misc_feature: HIJSMM301CESVN.46.35.D02.1.454.light.4.raw

SEQ ID NO: 567734 - DNA, 486 bp, Homo sapiens; identical to SEQ ID NO: 535043
  misc_feature: HIJSMM301BNFFG.46.35.D02.1.454.light.4.raw

SEQ ID NO: 567735 - DNA, 391 bp, Homo sapiens
  misc_feature: HIJSMM301C5TNA.51.81.H04.1.454.light.4.raw
cgatcgtatacacgaccggtgctcgatttagtagtgtagattcgcggggtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccgccctcctctcgtagcact

SEQ ID NO: 567736 - DNA, 502 bp, Homo sapiens
  misc_feature: HIJSMM301D26H8.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcagggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 567737 - DNA, 489 bp, Homo sapiens
  misc_feature: HIJSMM301AZX9L.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagtctggtaccagcagaaacctggccaggctcccaggctcctcatctctggtgcatccaccagggccactggtatcctggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccat

SEQ ID NO: 567738 - DNA, 510 bp, Homo sapiens
  misc_feature: HIJSMM301EN6ZP.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcgctacgt

SEQ ID NO: 567739 - DNA, 471 bp, Homo sapiens
  misc_feature: HIJSMM301CV108.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagaccc

SEQ ID NO: 567740 - DNA, 501 bp, Homo sapiens
  misc_feature: HIJSMM301B4KTV.48.41.D08.1.454.light.4.raw
agtatacatacacgaccggtgctcgatttagtcacgcgagaaagggaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 567741 - DNA, 487 bp, Homo sapiens
  misc_feature: HIJSMM301DWJUG.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctccactttcggcggggggaccaaaggtggacgtcaaacgaactgtggctgcacca

SEQ ID NO: 567742 - DNA, 516 bp, Homo sapiens
  misc_feature: HIJSMM301ALQF5.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccaacggtggaaagttacaaacgaaacctagtggctggcaccaatcttgtcttctatcttccccg

SEQ ID NO: 567743 - DNA, 454 bp, Homo sapiens; identical to SEQ ID NO: 534964
  misc_feature: HIJSMM301CEH05.19.86.H09.1.454.light.4.raw

SEQ ID NO: 567744 - DNA, 482 bp, Homo sapiens
  misc_feature: HIJSMM301BY2UJ.41.47.E03.1.454.light.4.raw
tctatactatcacgaccggtgctcgatttagactcgcgcacagagagaagggggatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaatcagtagagtggaggctgaggatgttggcgactattactgcctgcaagctcggcaattcccgatcaccttcggccccggacacgactggacattaaacgaa

SEQ ID NO: 567745 - DNA, 497 bp, Homo sapiens
  misc_feature: HIJSMM301B0MTW.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctcgcccccc

SEQ ID NO: 567746 - DNA, 486 bp, Homo sapiens; identical to SEQ ID NO: 535385
  misc_feature: HIJSMM301EF4NZ.19.71.G05.1.454.light.4.raw

SEQ ID NO: 567747 - DNA, 486 bp, Homo sapiens
  misc_feature: HIJSMM301D2931.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtataataactggcctccgtacacttttggccaggggaccaagctggagatcaaacgaactgtggctgcaccatctgt

SEQ ID NO: 567748 - DNA, 488 bp, Homo sapiens
  misc_feature: HIJSMM301ETK1W.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgcgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcacat

SEQ ID NO: 567749 - DNA, 487 bp, Homo sapiens; identical to SEQ ID NO: 536206
  misc_feature: HIJSMM301CEPHN.47.38.D05.1.454.light.4.raw

SEQ ID NO: 567750 - DNA, 496 bp, Homo sapiens; identical to SEQ ID NO: 535109
  misc_feature: HIJSMM301AIOZO.16.78.H01.1.454.light.4.raw

SEQ ID NO: 567751 - DNA, 486 bp, Homo sapiens
  misc_feature: HIJSMM301CDXLH.13.53.E09.1.454.light.4.raw
tcacgtactacacgaccggtgctcgatttagagagagtgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtattcggcggggggacccagctgaccgtcctaggtcagcccaac

SEQ ID NO: 567752 - DNA, 447 bp, Homo sapiens; identical to SEQ ID NO: 535201
  misc_feature: HIJSMM301CMEJQ.18.9.A09.1.454.light.4.raw

SEQ ID NO: 567753 - DNA, 484 bp, Homo sapiens
  misc_feature: HIJSMM301B8JID.13.59.F04.1.454.light.4.raw
tcacgtactacacgaccggtgctcgatttagtacacacacttagggattgggggcgagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaacgaactgtggctgca

SEQ ID NO: 567754 - DNA, 499 bp, Homo sapiens
  misc_feature: HIJSMM301DH40N.40.59.F04.1.454.light.4.raw
tctagcgactcacgaccggtgctcgatttagtacacacacttagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcacatctgtcttcacttcc

SEQ ID NO: 567755 - DNA, 488 bp, Homo sapiens
  misc_feature: HIJSMM301EIRGW.51.3.A03.1.454.light.4.raw
cgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccaagtctggcacctcagcctccctggccatcagtggcctccagtctgaggatgagggtgattattactgtgcagcatgggatgacagcctgaatggggccctgttcggcggagggaccaagctgaccgtcctaagtcagtccaaggctgccccctcggt

SEQ ID NO: 567756 - DNA, 485 bp, Homo sapiens; identical to SEQ ID NO: 535606
  misc_feature: HIJSMM301D35DL.47.46.E02.1.454.light.4.raw

SEQ ID NO: 567757 - DNA, 472 bp, Homo sapiens; identical to SEQ ID NO: 538929
  misc_feature: HIJSMM301AK352.12.1.A01.1.454.light.4.raw

SEQ ID NO: 567758 - DNA, 508 bp, Homo sapiens
  misc_feature: HIJSMM301AGSG9.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggtgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccgaacgtggaaatcaaacgaactgtggctgcaccatctgtcttcta

SEQ ID NO: 567759 - DNA, 492 bp, Homo sapiens; identical to SEQ ID NO: 536175
  misc_feature: HIJSMM301DGIRV.19.83.H06.1.454.light.4.raw

SEQ ID NO: 567760 - DNA, 503 bp, Homo sapiens
  misc_feature: HIJSMM301ADYB7.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggtcccacgggaccgacacgtggatattcaggcgaacgtacgtggcgtgcaccatctgtcttt

SEQ ID NO: 567761 - DNA, 496 bp, Homo sapiens
  misc_feature: HIJSMM301C64UD.3.14.B03.1.454.light.4.raw
agacgcactccacgaccggtgctcgatttagtgtgagtagttccgcggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctactttatttctgtcagcagtataataactggcctccgtggacgttcggccggggaccgaaggtggagatacaaacgaactagtggctgcaccatctgtctt

SEQ ID NO: 567762 - DNA, 505 bp, Homo sapiens; identical to SEQ ID NO: 536254
  misc_feature: HIJSMM301DUZDM.7.71.G05.1.454.light.4.raw

SEQ ID NO: 567763 - DNA, 499 bp, Homo sapiens; identical to SEQ ID NO: 536875
  misc_feature: HIJSMM301BD4QL.51.26.C04.1.454.light.4.raw

SEQ ID NO: 567764 - DNA, 467 bp, Homo sapiens; identical to SEQ ID NO: 560656
  misc_feature: HIJSMM301AYJUJ.11.70.G04.1.454.light.4.raw

SEQ ID NO: 567765 - DNA, 486 bp, Homo sapiens; identical to SEQ ID NO: 560137
  misc_feature: HIJSMM301BF027.47.78.H01.1.454.light.4.raw

SEQ ID NO: 567766 - DNA, 488 bp, Homo sapiens; identical to SEQ ID NO: 535990
  misc_feature: HIJSMM301BL0IU.11.28.C06.1.454.light.4.raw

SEQ ID NO: 567767 - DNA, 511 bp, Homo sapiens
  misc_feature: HIJSMM301CI09L.51.38.D05.1.454.light.4.raw
cgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctcgccccctcggtcca

SEQ ID NO: 567768 - DNA, 495 bp, Homo sapiens; identical to SEQ ID NO: 554164
  misc_feature: HIJSMM301AGMYI.27.78.H01.1.454.light.4.raw

SEQ ID NO: 567769 - DNA, 518 bp, Homo sapiens
  misc_feature: HIJSMM301BLKPE.40.46.E02.1.454.light.4.raw
tctagcgactcacgaccggtgctcgatttagactcatctacagggaaaggggagtctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaacccactgtcactctgttcccaccctcctcagtcg

SEQ ID NO: 567770 - DNA, 443 bp, Homo sapiens
  misc_feature: HIJSMM301BT5QT.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcgagggaccaagctgaccgtcctaggtcagcccaaggctgccccctcggtcactctgttcccaccctcctcagacgtatca

SEQ ID NO: 567771 - DNA, 489 bp, Homo sapiens
  misc_feature: HIJSMM301AJOXR.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagtattttgctaacttacttttgtcaacaggctaacagtttccctccgaccttcggtccgaagggacacgactggagattaaacgaactagtggctgcacactt

SEQ ID NO: 567772 - DNA, 481 bp, Homo sapiens
  misc_feature: HIJSMM301DR6UW.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacaccctgcgtggtttttggctgttcggcggcgggacc

SEQ ID NO: 567773 - DNA, 490 bp, Homo sapiens; identical to SEQ ID NO: 538273
  misc_feature: HIJSMM301DILTC.16.73.G07.1.454.light.4.raw

SEQ ID NO: 567774 - DNA, 507 bp, Homo sapiens; identical to SEQ ID NO: 540930
  misc_feature: HIJSMM301A606T.8.34.D01.1.454.light.4.raw

SEQ ID NO: 567775 - DNA, 488 bp, Homo sapiens
  misc_feature: HIJSMM301BHK3Z.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcgccaggaccgaaggtggaagtcaacgaactgtggctgcaccatctgtctt

SEQ ID NO: 567776 - DNA, 507 bp, Homo sapiens; identical to SEQ ID NO: 564521
  misc_feature: HIJSMM301D82QI.21.87.H10.1.454.light.4.raw

SEQ ID NO: 567777 - DNA, 447 bp, Homo sapiens; identical to SEQ ID NO: 535020
  misc_feature: HIJSMM301CQM2J.18.9.A09.1.454.light.4.raw

SEQ ID NO: 567778 - DNA, 500 bp, Homo sapiens
  misc_feature: HIJSMM301D7NF3.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctcctgaccgtctctgggctccaggctgaggatgaggctgattattattgcagctcatatgcaggcagttacaatgtgatattcggcggagggaccaaatgaccgtcctaggtcagcccaaggctgccccctc

SEQ ID NO: 567779 - DNA, 507 bp, Homo sapiens; identical to SEQ ID NO: 549089
  misc_feature: HIJSMM301CF1VM.5.24.C02.1.454.light.4.raw

SEQ ID NO: 567780 - DNA, 507 bp, Homo sapiens
  misc_feature: HIJSMM301ADEXA.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggctgtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 567781 - DNA, 494 bp, Homo sapiens
  misc_feature: HIJSMM301DFB4W.52.60.F05.1.454.light.4.raw
cgcagtacgacacgaccggtgctcgatttagtacgtcatcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgcta

SEQ ID NO: 567782 - DNA, 484 bp, Homo sapiens
  misc_feature: HIJSMM301EQ7LV.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacacttcggtcggagggacgaacggtaggaggaagtcaaacgaaactagtggcgtgc

SEQ ID NO: 567783 - DNA, 484 bp, Homo sapiens; identical to SEQ ID NO: 535240
  misc_feature: HIJSMM301C5UHR.47.60.F05.1.454.light.4.raw

SEQ ID NO: 567784 - DNA, 493 bp, Homo sapiens; identical to SEQ ID NO: 537422
  misc_feature: HIJSMM301B1MQD.9.34.D01.1.454.light.4.raw

SEQ ID NO: 567785 - DNA, 492 bp, Homo sapiens
  misc_feature: HIJSMM301BOV9P.5.57.F02.1.454.light.4.raw
atcagacacgcacgaccggtgctcgatttagctcgatatagttgggtttggggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccaggaccacagtggatatcaggcgaactgtggctgcacatctgtcttcta

SEQ ID NO: 567786 - DNA, 486 bp, Homo sapiens; identical to SEQ ID NO: 535043
  misc_feature: HIJSMM301EQ1UI.46.35.D02.1.454.light.4.raw

SEQ ID NO: 567787 - DNA, 447 bp, Homo sapiens; identical to SEQ ID NO: 535201
  misc_feature: HIJSMM301AHK4W.18.9.A09.1.454.light.4.raw

SEQ ID NO: 567788 - DNA, 486 bp, Homo sapiens; identical to SEQ ID NO: 545000
  misc_feature: HIJSMM301EQ6QO.49.53.E09.1.454.light.4.raw

SEQ ID NO: 567789 - DNA, 505 bp, Homo sapiens; identical to SEQ ID NO: 535503
  misc_feature: HIJSMM301ENM6W.8.28.C06.1.454.light.4.raw

SEQ ID NO: 567790 - DNA, 514 bp, Homo sapiens
  misc_feature: HIJSMM301C73FP.49.71.G05.1.454.light.4.raw
agtcgagagacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaacccactgtcactctcgttcccgccct

SEQ ID NO: 567791 - DNA, 520 bp, Homo sapiens
  misc_feature: HIJSMM301BLE36.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccaccct

SEQ ID NO: 567792 - DNA, 488 bp, Homo sapiens
  misc_feature: HIJSMM301CU7ES.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggattattgctagtttatactgtcagcagtatactaacgtgcctctgacgttcggaccgaagggaccgagggtaggaaatacaaacgactgtgctgcaccatcttcg

SEQ ID NO: 567793 - DNA, 493 bp, Homo sapiens; identical to SEQ ID NO: 535770
  misc_feature: HIJSMM301C8G8H.51.71.G05.1.454.light.4.raw

SEQ ID NO: 567794 - DNA, 486 bp, Homo sapiens
  misc_feature: HIJSMM301DJ10D.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgtccccccg

SEQ ID NO: 567795 - DNA, 488 bp, Homo sapiens
  misc_feature: HIJSMM301A92AZ.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgctactttattactgtcagcaatataatgactggttctcgatcaccttcggccaagggacacgactggagattaaacgaactgtggctgcaccatctgtt

SEQ ID NO: 567796 - DNA, 518 bp, Homo sapiens; identical to SEQ ID NO: 539372
  misc_feature: HIJSMM301AQ7S8.7.86.H09.1.454.light.4.raw

SEQ ID NO: 567797 - DNA, 492 bp, Homo sapiens
  misc_feature: HIJSMM301BSZ23.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaac

SEQ ID NO: 567798 - DNA, 516 bp, Homo sapiens
  misc_feature: HIJSMM301A2CSO.14.19.B08.1.454.light.4.raw
cgtctagtaccacgaccggtgctcgatttagtgagtcagtaaaaaaaagggaagagaagacaggattcaggacaatctccagcatggccggcttccctctcctcctcaccctcctcactcactgtgcagggtcctggcccagtctgtgctgactcagccaccctcagcgtctgggaccccgggcagagggtcaccatctcttgttctggaagcagctccaaatcggaagtcgttatgtatactggttccagcagctccaggaacggccccaacctcctcatctataggaataatcagcggccctcagggtcctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctcgccccctcggtcactctgttcccaccctcctccg

SEQ ID NO: 567799 - DNA, 494 bp, Homo sapiens; identical to SEQ ID NO: 534994
  misc_feature: HIJSMM301DKU6T.27.78.H01.1.454.light.4.raw

SEQ ID NO: 567800 - DNA, 507 bp, Homo sapiens
  misc_feature: HIJSMM301ALXS8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaactagtggctgcaccatctgtcttcatcttccccg

SEQ ID NO: 567801 - DNA, 513 bp, Homo sapiens
  misc_feature: HIJSMM301BEUW5.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccgccctcctcgagtagtaca

SEQ ID NO: 567802 - DNA, 494 bp, Homo sapiens; identical to SEQ ID NO: 535276
  misc_feature: HIJSMM301ESAHA.16.6.A06.1.454.light.4.raw

SEQ ID NO: 567803 - DNA, 489 bp, Homo sapiens; identical to SEQ ID NO: 553074
  misc_feature: HIJSMM301AMANC.14.33.C11.1.454.light.4.raw

SEQ ID NO: 567804 - DNA, 507 bp, Homo sapiens
  misc_feature: HIJSMM301BEIBA.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggagggaccaggctgaccgtccaagtcagcccaaggctgccccctc

SEQ ID NO: 567805 - DNA, 494 bp, Homo sapiens; identical to SEQ ID NO: 534994
  misc_feature: HIJSMM301B4VGP.27.78.H01.1.454.light.4.raw

SEQ ID NO: 567806 - DNA, 422 bp, Homo sapiens; identical to SEQ ID NO: 447881
  misc_feature: HIJSMM301BI0HH.9.34.D01.1.454.light.4.raw

SEQ ID NO: 567807 - DNA, 485 bp, Homo sapiens
  misc_feature: HIJSMM301B3WGD.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 567808 - DNA, 447 bp, Homo sapiens; identical to SEQ ID NO: 535201
  misc_feature: HIJSMM301C988P.18.9.A09.1.454.light.4.raw

SEQ ID NO: 567809 - DNA, 518 bp, Homo sapiens
  misc_feature: HIJSMM301D060Y.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctgttcccaccctcctcacta

SEQ ID NO: 567810 - DNA, 488 bp, Homo sapiens; identical to SEQ ID NO: 545628
  misc_feature: HIJSMM301EE0I4.14.55.E11.1.454.light.4.raw

SEQ ID NO: 567811 - DNA, 515 bp, Homo sapiens; identical to SEQ ID NO: 541898
  misc_feature: HIJSMM301CI68B.16.66.F11.1.454.light.4.raw

SEQ ID NO: 567812 - DNA, 495 bp, Homo sapiens; identical to SEQ ID NO: 566036
  misc_feature: HIJSMM301DWCRR.16.78.H01.1.454.light.4.raw

SEQ ID NO: 567813 - DNA, 490 bp, Homo sapiens
  misc_feature: HIJSMM301ALJ3R.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcagggagatggtgaccgtctgcccgtcggggccccagacaccggagggcggctgcgtcagcacagacgtcgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgagggtccctgaccgattctctggctccaagtctggcacctcagcctccctggtcatcgctgggctccaggctgacgatgaggctgattattattgcctagtcctatgacaacaccctgtcgtggttttggtctgttcggcggcgggacc

SEQ ID NO: 567814 - DNA, 508 bp, Homo sapiens; identical to SEQ ID NO: 540739
  misc_feature: HIJSMM301DFBDS.14.7.A07.1.454.light.4.raw

SEQ ID NO: 567815 - DNA, 460 bp, Homo sapiens; identical to SEQ ID NO: 536053
  misc_feature: HIJSMM301AOP61.22.28.C06.1.454.light.4.raw

SEQ ID NO: 567816 - DNA, 505 bp, Homo sapiens
  misc_feature: HIJSMM301D9W5G.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaacgtagtggctgcaccatctgtcttcatcttcccgccta

SEQ ID NO: 567817 - DNA, 401 bp, Homo sapiens
  misc_feature: HIJSMM301B4HPD.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagcgggacccaggctatggatgaggctgactattactgtcaggcgtgggacagcagcactccctatgtcttcggcactgggaccaaggtcaccgtcctaggtcagcccaaggccaaccccactgtcactctgttcccaccctcctcctacagtgct

SEQ ID NO: 567818 - DNA, 465 bp, Homo sapiens
  misc_feature: HIJSMM301AZCVM.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaatggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaa

SEQ ID NO: 567819 - DNA, 507 bp, Homo sapiens
  misc_feature: HIJSMM301D4PSJ.18.78.H01.1.454.light.4.raw
tacgagtatgcacgaccggtgctcgatttagtgtgagtagtttgggtttggggggggtcgtcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaacctcatgatttatgatgtcagtaatcggccctcaggggtttctaatcgcttctctggctccaagtctggcaacatggcctccctgaccatctctgggctccaggctgaggacgaggctgattattactgcagctcatatacaagcagcagcactcaagtcttcggaactgggaccaaggtcaccgtcctaggtcagcccaaggccaacccccactgt

SEQ ID NO: 567820 - DNA, 495 bp, Homo sapiens; identical to SEQ ID NO: 564072
  misc_feature: HIJSMM301C0QSN.11.81.H04.1.454.light.4.raw

SEQ ID NO: 567821 - DNA, 519 bp, Homo sapiens
  misc_feature: HIJSMM301DL72E.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcgggggaccgacactgaccgtcctaggtcagcccaaggctgccccctcggtcactctgttccccg

SEQ ID NO: 567822 - DNA, 488 bp, Homo sapiens; identical to SEQ ID NO: 537124
  misc_feature: HIJSMM301AY5KB.11.25.C03.1.454.light.4.raw

SEQ ID NO: 567823 - DNA, 511 bp, Homo sapiens
  misc_feature: HIJSMM301B2RBZ.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctgtcccgcct

SEQ ID NO: 567824 - DNA, 485 bp, Homo sapiens; identical to SEQ ID NO: 538533
  misc_feature: HIJSMM301DT9MW.47.78.H01.1.454.light.4.raw

SEQ ID NO: 567825 - DNA, 506 bp, Homo sapiens
  misc_feature: HIJSMM301D0O9M.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaaagtcgtgtcactatgatttttggcggaggcaccaaggtgaccgtcctaggtcagcccaaggctgccccctcggtca

SEQ ID NO: 567826 - DNA, 502 bp, Homo sapiens
  misc_feature: HIJSMM301DHVTV.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagttttattactgtcagcagcgtgccactttcggcggaggtgccactttcggcggagggaccaaaatagaggtacaaacgaacgtgtggctgcaccatctgtcttc

SEQ ID NO: 567827 - DNA, 509 bp, Homo sapiens; identical to SEQ ID NO: 536047
  misc_feature: HIJSMM301A8YSZ.17.33.C11.1.454.light.4.raw

SEQ ID NO: 567828 - DNA, 447 bp, Homo sapiens; identical to SEQ ID NO: 535201
  misc_feature: HIJSMM301D87SC.18.9.A09.1.454.light.4.raw

SEQ ID NO: 567829 - DNA, 486 bp, Homo sapiens; identical to SEQ ID NO: 535043
  misc_feature: HIJSMM301AXM27.46.35.D02.1.454.light.4.raw

SEQ ID NO: 567830 - DNA, 510 bp, Homo sapiens
  misc_feature: HIJSMM301DQTU3.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccgggacagaagtggtaattacatggtgttcggcggagggaccaagctgaccgtcctacgtcagcccaaggctcgccccctcggtcactctccg

SEQ ID NO: 567831 - DNA, 501 bp, Homo sapiens
  misc_feature: HIJSMM301A9R25.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgaccgtctaggtcagcccaaggctgccccctcggtcactctgtt

SEQ ID NO: 567832 - DNA, 506 bp, Homo sapiens
  misc_feature: HIJSMM301BCIE1.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctggtcattctgttcccg

SEQ ID NO: 567833 - DNA, 493 bp, Homo sapiens; identical to SEQ ID NO: 540127
  misc_feature: HIJSMM301AKG6Y.10.17.B06.1.454.light.4.raw

SEQ ID NO: 567834 - DNA, 463 bp, Homo sapiens
  misc_feature: HIJSMM301BSOXO.51.16.B05.1.454.light.4.raw
cgatcgtatacacgaccggtgctcgatttagagctcacgtaaggggggaactgctcagttaggacccagacggaaccatggaagccccagctcagcttctcttcctcctgctactctggctcccaggggaaagagtcaccctctcctacagggccagtcagagtgttagcagcagctgcttaacctggtatcagcagaaacctggccaggcgcccagactcctcatctatggtgcatccaccagggccactagcatcccagccaggttcagtggcagtgggtctgggacagacttcactctcaccatcagcagcctgcagcctgaagattttgcagtttattactgtcagcaggattataacttacctccggggggacgttcggccaagggaccaaagtggaaatcaagcgaactgtggctgcaccatctgtcttcatcttcccgccatctgatcgtagcact

SEQ ID NO: 567835 - DNA, 445 bp, Homo sapiens; identical to SEQ ID NO: 563937
  misc_feature: HIJSMM301A0MQW.10.76.G10.1.454.light.4.raw

SEQ ID NO: 567836 - DNA, 447 bp, Homo sapiens; identical to SEQ ID NO: 535020
  misc_feature: HIJSMM301DQD34.18.9.A09.1.454.light.4.raw

SEQ ID NO: 567837 - DNA, 493 bp, Homo sapiens; identical to SEQ ID NO: 540127
  misc_feature: HIJSMM301EZR0S.10.17.B06.1.454.light.4.raw

SEQ ID NO: 567838 - DNA, 485 bp, Homo sapiens; identical to SEQ ID NO: 535880
  misc_feature: HIJSMM301B711B.7.75.G09.1.454.light.4.raw

SEQ ID NO: 567839 - DNA, 480 bp, Homo sapiens; identical to SEQ ID NO: 555806
  misc_feature: HIJSMM301AUZYY.7.76.G10.1.454.light.4.raw

SEQ ID NO: 567840 - DNA, 505 bp, Homo sapiens; identical to SEQ ID NO: 536254
  misc_feature: HIJSMM301DQDR0.7.71.G05.1.454.light.4.raw

SEQ ID NO: 567841 - DNA, 501 bp, Homo sapiens; identical to SEQ ID NO: 543209
  misc_feature: HIJSMM301DKWIW.52.55.E11.1.454.light.4.raw

SEQ ID NO: 567842 - DNA, 498 bp, Homo sapiens
  misc_feature: HIJSMM301CY3PI.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgatttcggcgggggaccaggctgaccgtcggcggtcagcccaaggctgccccctcggtcactctcgtcccg

SEQ ID NO: 567843 - DNA, 491 bp, Homo sapiens
  misc_feature: HIJSMM301B5OJJ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactagtggctgcaccactct

SEQ ID NO: 567844 - DNA, 490 bp, Homo sapiens
  misc_feature: HIJSMM301DZLV8.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaaacttgctcattttcggcggagggaccaaggtggagatcaaacgaactgtggctgcaccatctgt

SEQ ID NO: 567845 - DNA, 502 bp, Homo sapiens
  misc_feature: HIJSMM301BKHPW.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctggtca

SEQ ID NO: 567846 - DNA, 444 bp, Homo sapiens; identical to SEQ ID NO: 534993
  misc_feature: HIJSMM301DYQK6.5.9.A09.1.454.light.4.raw

SEQ ID NO: 567847 - DNA, 488 bp, Homo sapiens
  misc_feature: HIJSMM301B6IFT.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaacgggaccgaacggtaggaaagtacaaacgaactagtggcgtgcacca

SEQ ID NO: 567848 - DNA, 499 bp, Homo sapiens
  misc_feature: HIJSMM301COB7I.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactctgttccccg

SEQ ID NO: 567849 - DNA, 495 bp, Homo sapiens
  misc_feature: HIJSMM301BD892.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttactttacctcaagtgatcaccttcggccaagggacacgactggagattaaacgaactgtggctgcaccatctgtctt

SEQ ID NO: 567850 - DNA, 480 bp, Homo sapiens
  misc_feature: HIJSMM301AZ5EY.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttggctgttcggcggcggaacc

SEQ ID NO: 567851 - DNA, 497 bp, Homo sapiens
  misc_feature: HIJSMM301DDSD1.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggcttcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaaactgtggctgcaccatctgtcttcatcttcccgcc

SEQ ID NO: 567852 - DNA, 481 bp, Homo sapiens; identical to SEQ ID NO: 535993
  misc_feature: HIJSMM301D68VU.21.25.C03.1.454.light.4.raw

SEQ ID NO: 567853 - DNA, 495 bp, Homo sapiens; identical to SEQ ID NO: 536316
  misc_feature: HIJSMM301AEGIE.40.23.C01.1.454.light.4.raw

SEQ ID NO: 567854 - DNA, 507 bp, Homo sapiens
  misc_feature: HIJSMM301BHNH5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaacggaccgaacggtaggagtatacagacgaacgtagtggtcgtgt

SEQ ID NO: 567855 - DNA, 505 bp, Homo sapiens; identical to SEQ ID NO: 535503
  misc_feature: HIJSMM301CHDOM.8.28.C06.1.454.light.4.raw

SEQ ID NO: 567856 - DNA, 342 bp, Homo sapiens
  misc_feature: HIJSMM301C4NHA.4.67.G01.1.454.light.4.raw
agcactgtagcacgaccggtgctcgatttagagtatacatattggttactatgactttgtctcctggtaccaacaacacccaggcaaagccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagtccaaggctgccccctcggtcactctgttcccaccctcctcctacagtgct

SEQ ID NO: 567857 - DNA, 507 bp, Homo sapiens
  misc_feature: HIJSMM301EACXK.16.1.A01.1.454.light.4.raw
tgtactactccacgaccggtgctcgatttagacgtctcatcagggggagtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgaccaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgtt

SEQ ID NO: 567858 - DNA, 441 bp, Homo sapiens; identical to SEQ ID NO: 534971
  misc_feature: HIJSMM301DDI3Y.11.3.A03.1.454.light.4.raw

SEQ ID NO: 567859 - DNA, 441 bp, Homo sapiens; identical to SEQ ID NO: 534971
  misc_feature: HIJSMM301B0XT7.11.3.A03.1.454.light.4.raw

SEQ ID NO: 567860 - DNA, 493 bp, Homo sapiens
  misc_feature: HIJSMM301CSNR0.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtgaaatcaaacgaactgtgctgcacc

SEQ ID NO: 567861 - DNA, 490 bp, Homo sapiens; identical to SEQ ID NO: 535526
  misc_feature: HIJSMM301C090U.26.78.H01.1.454.light.4.raw

SEQ ID NO: 567862 - DNA, 481 bp, Homo sapiens
  misc_feature: HIJSMM301CQ2MB.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatcctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcgggtggagatcagacgaactgtggctgcaccatctgtctt

SEQ ID NO: 567863 - DNA, 504 bp, Homo sapiens; identical to SEQ ID NO: 563936
  misc_feature: HIJSMM301CPVPC.18.59.F04.1.454.light.4.raw

SEQ ID NO: 567864 - DNA, 489 bp, Homo sapiens; identical to SEQ ID NO: 536663
  misc_feature: HIJSMM301ETFRT.16.72.G06.1.454.light.4.raw

SEQ ID NO: 567865 - DNA, 494 bp, Homo sapiens
  misc_feature: HIJSMM301DYA7B.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggtccaacggacgacgactggagattaaacgaaactgtggctgcaccactctgtcttcat

SEQ ID NO: 567866 - DNA, 503 bp, Homo sapiens
  misc_feature: HIJSMM301DEK0M.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcaggcagcaacaatttcagggtatttggcggagggaccaagctgaccgtcctgggtcagcccaaggctgccccccg

SEQ ID NO: 567867 - DNA, 494 bp, Homo sapiens
  misc_feature: HIJSMM301C5H1R.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccatcctccctgtctgtatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggccccctatacttttggccaggggaccaagctggagatcacaggaactgtggctgcaccatctgtcttcatt

SEQ ID NO: 567868 - DNA, 447 bp, Homo sapiens; identical to SEQ ID NO: 535201
  misc_feature: HIJSMM301B0J6T.18.9.A09.1.454.light.4.raw

SEQ ID NO: 567869 - DNA, 498 bp, Homo sapiens
  misc_feature: HIJSMM301CPW34.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttgccaggggaccaaggttgaagtcaaacgaactgtggctgcaccatctgtcttcatt

SEQ ID NO: 567870 - DNA, 491 bp, Homo sapiens; identical to SEQ ID NO: 552513
  misc_feature: HIJSMM301A4J2K.48.34.D01.1.454.light.4.raw

SEQ ID NO: 567871 - DNA, 493 bp, Homo sapiens; identical to SEQ ID NO: 546638
  misc_feature: HIJSMM301EFQG8.13.11.A11.1.454.light.4.raw

SEQ ID NO: 567872 - DNA, 495 bp, Homo sapiens
  misc_feature: HIJSMM301B9TYZ.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccctcggtcactctgttcccgccctcctcgagtgcgtct

SEQ ID NO: 567873 - DNA, 485 bp, Homo sapiens
  misc_feature: HIJSMM301CMKL5.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcgttcggccagggaccaaggtggaagtcaagcgaactgtgctgcaccatctgt

SEQ ID NO: 567874 - DNA, 497 bp, Homo sapiens; identical to SEQ ID NO: 539718
  misc_feature: HIJSMM301CHGC7.40.54.E10.1.454.light.4.raw

SEQ ID NO: 567875 - DNA, 488 bp, Homo sapiens; identical to SEQ ID NO: 540827
  misc_feature: HIJSMM301C8H8J.15.49.E05.1.454.light.4.raw

SEQ ID NO: 567876 - DNA, 441 bp, Homo sapiens; identical to SEQ ID NO: 534971
  misc_feature: HIJSMM301BOWLP.11.3.A03.1.454.light.4.raw

SEQ ID NO: 567877 - DNA, 504 bp, Homo sapiens; identical to SEQ ID NO: 562026
  misc_feature: HIJSMM301B61ZR.9.71.G05.1.454.light.4.raw

SEQ ID NO: 567878 - DNA, 497 bp, Homo sapiens
  misc_feature: HIJSMM301BPPH3.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccc

SEQ ID NO: 567879 - DNA, 481 bp, Homo sapiens; identical to SEQ ID NO: 540211
  misc_feature: HIJSMM301DCQI6.12.10.A10.1.454.light.4.raw

SEQ ID NO: 567880 - DNA, 485 bp, Homo sapiens; identical to SEQ ID NO: 539315
  misc_feature: HIJSMM301ECRFI.3.88.H11.1.454.light.4.raw

SEQ ID NO: 567881 - DNA, 505 bp, Homo sapiens
  misc_feature: HIJSMM301CGCP3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccgaaggaccgaacggtggaaatacaaacgaactagtggctgcaccatctgtcttcatcttccccg

SEQ ID NO: 567882 - DNA, 521 bp, Homo sapiens; identical to SEQ ID NO: 538715
  misc_feature: HIJSMM301DVUTE.27.23.C01.1.454.light.4.raw

SEQ ID NO: 567883 - DNA, 497 bp, Homo sapiens; identical to SEQ ID NO: 544475
  misc_feature: HIJSMM301DBOMK.12.87.H10.1.454.light.4.raw

SEQ ID NO: 567884 - DNA, 486 bp, Homo sapiens; identical to SEQ ID NO: 540131
  misc_feature: HIJSMM301EVZZC.52.23.C01.1.454.light.4.raw

SEQ ID NO: 567885 - DNA, 484 bp, Homo sapiens
  misc_feature: HIJSMM301BEIC7.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattacttgctcagcatgggacaccggcctcagtgcgtgggttttcggcggagggaccgaagctgaccgtcctaggtcacgg

SEQ ID NO: 567886 - DNA, 515 bp, Homo sapiens
  misc_feature: HIJSMM301D6U9E.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccg

SEQ ID NO: 567887 - DNA, 515 bp, Homo sapiens; identical to SEQ ID NO: 554201
  misc_feature: HIJSMM301BZJ2S.12.85.H08.1.454.light.4.raw

SEQ ID NO: 567888 - DNA, 512 bp, Homo sapiens
  misc_feature: HIJSMM301CREIP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggaacagatttcactctcaccatcagcagcctgcaggctgaagatgtggcagtttattactgtcaacagttttctcgggcgttcggccaacgggaccgaaggtaggaaatacgaaacgaactagtggcgtgcaccactctgtcttctatcttccccg

SEQ ID NO: 567889 - DNA, 502 bp, Homo sapiens
  misc_feature: HIJSMM301DPK8P.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggaggatcaaacgaactgtggctgcacc

SEQ ID NO: 567890 - DNA, 505 bp, Homo sapiens; identical to SEQ ID NO: 535503
  misc_feature: HIJSMM301AY2M7.8.28.C06.1.454.light.4.raw

SEQ ID NO: 567891 - DNA, 485 bp, Homo sapiens; identical to SEQ ID NO: 536040
  misc_feature: HIJSMM301CIYJ2.15.1.A01.1.454.light.4.raw

SEQ ID NO: 567892 - DNA, 481 bp, Homo sapiens; identical to SEQ ID NO: 535993
  misc_feature: HIJSMM301D8ZSF.21.25.C03.1.454.light.4.raw

SEQ ID NO: 567893 - DNA, 486 bp, Homo sapiens; identical to SEQ ID NO: 535385
  misc_feature: HIJSMM301DHKS8.19.71.G05.1.454.light.4.raw

SEQ ID NO: 567894 - DNA, 486 bp, Homo sapiens; identical to SEQ ID NO: 535043
  misc_feature: HIJSMM301B409N.46.35.D02.1.454.light.4.raw

SEQ ID NO: 567895 - DNA, 454 bp, Homo sapiens; identical to SEQ ID NO: 536347
  misc_feature: HIJSMM301EN6QL.19.86.H09.1.454.light.4.raw

SEQ ID NO: 567896 - DNA, 496 bp, Homo sapiens
  misc_feature: HIJSMM301CJ2SK.3.10.A10.1.454.light.4.raw
agacgcactccacgaccggtgctcgatttagcgtcgatctcaggggagagctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttattctgtcagcagtacaataattggcctttgacgttcggccaagggaccaaggtggaaactaaacgaactgtggctgcaccatctgtctt

SEQ ID NO: 567897 - DNA, 488 bp, Homo sapiens; identical to SEQ ID NO: 540982
  misc_feature: HIJSMM301ARLBH.8.4.A04.1.454.light.4.raw

SEQ ID NO: 567898 - DNA, 496 bp, Homo sapiens
  misc_feature: HIJSMM301C5YZ5.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacactttgtcacgggaccgaagactggagatcaaacgaaactagtggctgcaccatct

SEQ ID NO: 567899 - DNA, 492 bp, Homo sapiens
  misc_feature: HIJSMM301DREX2.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtctaggtcagcccg

SEQ ID NO: 567900 - DNA, 499 bp, Homo sapiens
  misc_feature: HIJSMM301CEQPH.3.3.A03.1.454.light.4.raw
agacgcactccacgaccggtgctcgatttagagagcgtcacagggcacgaccggtgctcgatttagagagcgtcacagggggagagtgttagagggagaagtgcccccacgggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggtaccgg

SEQ ID NO: 567901 - DNA, 484 bp, Homo sapiens
  misc_feature: HIJSMM301B0BNQ.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaaggacccgaaggtggaaagtcaaaccgaaactcgttgg

SEQ ID NO: 567902 - DNA, 521 bp, Homo sapiens
  misc_feature: HIJSMM301B3BM4.13.77.G11.1.454.light.4.raw
tcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtcactctgttcccgccctcctc

SEQ ID NO: 567903 - DNA, 496 bp, Homo sapiens; identical to SEQ ID NO: 535109
  misc_feature: HIJSMM301BCPRN.16.78.H01.1.454.light.4.raw

SEQ ID NO: 567904 - DNA, 489 bp, Homo sapiens; identical to SEQ ID NO: 535139
  misc_feature: HIJSMM301AEPN2.14.55.E11.1.454.light.4.raw

SEQ ID NO: 567905 - DNA, 515 bp, Homo sapiens
  misc_feature: HIJSMM301AJN0J.40.18.B07.1.454.light.4.raw
tctagcgactcacgaccggtgctcgatttagtcgctgcgtaagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaaccccactgtcactctgttcccccg

SEQ ID NO: 567906 - DNA, 479 bp, Homo sapiens
  misc_feature: HIJSMM301DCD31.43.7.A07.1.454.light.4.raw
tgtgagtagtcacgaccggtgctcgatttagcacgtgtcgcaggggggggtctcaggaggcagcactctcgggacgtctccaccatggcctgggctctgctcctcctcagcctcctcactcagggcacaggatcgtggtctcagtctgccctgactcagcctcgctctctatccgggtctcctggacagtcagtcaccatcccctgcactggaaccagcaatgatgttggtacttataatcatgtctcctggtaccaacaatacccaggcaaggcccccaaactcatcattatcatgtcagtgagcggccctcagggtccctgatcgcttctctggctccaagtctggcaacacggcctccctgaccatctctgggctccaagggtgaggatgaggctgaaatattatgctgctcatatgctgtcatgggaggcagtttgtgggtgttcggcggagggacccagctgacgtccctaggc

SEQ ID NO: 567907 - DNA, 454 bp, Homo sapiens; identical to SEQ ID NO: 535005
  misc_feature: HIJSMM301A9LE0.19.86.H09.1.454.light.4.raw

SEQ ID NO: 567908 - DNA, 494 bp, Homo sapiens; identical to SEQ ID NO: 534992
  misc_feature: HIJSMM301A4E5G.9.1.A01.1.454.light.4.raw

SEQ ID NO: 567909 - DNA, 496 bp, Homo sapiens
  misc_feature: HIJSMM301BRM14.51.81.H04.1.454.light.4.raw
cgatcgtatacacgaccggtgctcgatttagtagtgtagattcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacccg

SEQ ID NO: 567910 - DNA, 496 bp, Homo sapiens
  misc_feature: HIJSMM301CM82S.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtgaagtcagacgaactgtggctgcaccatctgtcttcatt

SEQ ID NO: 567911 - DNA, 494 bp, Homo sapiens; identical to SEQ ID NO: 534994
  misc_feature: HIJSMM301BJP5Z.27.78.H01.1.454.light.4.raw

SEQ ID NO: 567912 - DNA, 510 bp, Homo sapiens; identical to SEQ ID NO: 537801
  misc_feature: HIJSMM301DHZNV.5.60.F05.1.454.light.4.raw

SEQ ID NO: 567913 - DNA, 486 bp, Homo sapiens; identical to SEQ ID NO: 537840
  misc_feature: HIJSMM301CR9D8.40.81.H04.1.454.light.4.raw

SEQ ID NO: 567914 - DNA, 518 bp, Homo sapiens; identical to SEQ ID NO: 539372
  misc_feature: HIJSMM301EELU1.7.86.H09.1.454.light.4.raw

SEQ ID NO: 567915 - DNA, 506 bp, Homo sapiens
  misc_feature: HIJSMM301E2KC8.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagttttattactgtcagcactataatagttggccgctcactttcggcggagggaccgaaggtaggaggctcaaaccgaaactgtggctgcaccaactctgttcttcatt

SEQ ID NO: 567916 - DNA, 494 bp, Homo sapiens; identical to SEQ ID NO: 534994
  misc_feature: HIJSMM301B69E2.27.78.H01.1.454.light.4.raw

SEQ ID NO: 567917 - DNA, 495 bp, Homo sapiens; identical to SEQ ID NO: 535007
  misc_feature: HIJSMM301CISEA.22.5.A05.1.454.light.4.raw

SEQ ID NO: 567918 - DNA, 507 bp, Homo sapiens
  misc_feature: HIJSMM301CSAKJ.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccg

SEQ ID NO: 567919 - DNA, 419 bp, Homo sapiens
  misc_feature: HIJSMM301BUBOQ.9.34.D01.1.454.light.4.raw
tgatacgtctcacgaccggtgctcgatttagatcgtctgtgttgggtttggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 567920 - DNA, 499 bp, Homo sapiens
  misc_feature: HIJSMM301C4B46.17.34.D01.1.454.light.4.raw
cgtagactagcacgaccggtgctcgatttagatcgtctgtgttgggtttggggtgatcaggacttctcagttcatcttctcaccatgaggctccctactcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactacaaacgaactgtggctgca

SEQ ID NO: 567921 - DNA, 447 bp, Homo sapiens; identical to SEQ ID NO: 535201
  misc_feature: HIJSMM301C8SJR.18.9.A09.1.454.light.4.raw

SEQ ID NO: 567922 - DNA, 512 bp, Homo sapiens; identical to SEQ ID NO: 556704
  misc_feature: HIJSMM301CII3J.40.12.B01.1.454.light.4.raw

SEQ ID NO: 567923 - DNA, 509 bp, Homo sapiens
  misc_feature: HIJSMM301C71VT.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagccaaggctgcccctcggtcactctgttcccgcctcctca

SEQ ID NO: 567924 - DNA, 485 bp, Homo sapiens; identical to SEQ ID NO: 535985
  misc_feature: HIJSMM301DAAM7.15.1.A01.1.454.light.4.raw

SEQ ID NO: 567925 - DNA, 519 bp, Homo sapiens; identical to SEQ ID NO: 557153
  misc_feature: HIJSMM301D8NQL.53.65.F10.1.454.light.4.raw

SEQ ID NO: 567926 - DNA, 490 bp, Homo sapiens
  misc_feature: HIJSMM301DMKOS.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaa

SEQ ID NO: 567927 - DNA, 503 bp, Homo sapiens
  misc_feature: HIJSMM301CPJLQ.7.1.A01.1.454.light.4.raw
cgtgtctctacacgaccggtgctcgatttagacgtctcatcaaggaagggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtctaggtcagcccaaggctgccccctc

SEQ ID NO: 567928 - DNA, 473 bp, Homo sapiens
  misc_feature: HIJSMM301CF560.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtgggtcccatcaaggttcagcggcagtggatctgggacagatttcactctcaccatcagcagcctacagcctgaagattttgcaacttattactgtcaacagcttaataattacgcgctcactttcggcgagggaccaaggtgagatcaaacgaactgtggctgcaccat

SEQ ID NO: 567929 - DNA, 498 bp, Homo sapiens
  misc_feature: HIJSMM301AEBDA.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgttcagcagtatagtaactggcctccgtacacttttggtccaggggaccaagctagaaatacaaacgaaactgtggctgcaccatctgtcttcta

SEQ ID NO: 567930 - DNA, 522 bp, Homo sapiens
  misc_feature: HIJSMM301B0WYG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctccggtcactctgttcccaccct

SEQ ID NO: 567931 - DNA, 504 bp, Homo sapiens
  misc_feature: HIJSMM301CD83O.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccta

SEQ ID NO: 567932 - DNA, 472 bp, Homo sapiens
  misc_feature: HIJSMM301CWZ0M.48.49.E05.1.454.light.4.raw
agtatacatacacgaccggtgctcgatttagagcgactagcaacacacaaaggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaa

SEQ ID NO: 567933 - DNA, 509 bp, Homo sapiens
  misc_feature: HIJSMM301AH5IE.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattttctgggtgttcggcggagggaccaaactgaccgtcctaggtcagcccaaggctgccccctcggtcactctgttcccc

SEQ ID NO: 567934 - DNA, 501 bp, Homo sapiens
  misc_feature: HIJSMM301A46SX.48.57.F02.1.454.light.4.raw
agtatacatacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 567935 - DNA, 486 bp, Homo sapiens
  misc_feature: HIJSMM301EHFBI.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggcccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagat

SEQ ID NO: 567936 - DNA, 498 bp, Homo sapiens
  misc_feature: HIJSMM301DHXS6.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcccacgtcctaggtcagcccaagg

SEQ ID NO: 567937 - DNA, 483 bp, Homo sapiens
  misc_feature: HIJSMM301A2BOC.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcagctctacaagtcccgctcactttcggcggagggaccaaggtggagatcaaacgaa

SEQ ID NO: 567938 - DNA, 488 bp, Homo sapiens
  misc_feature: HIJSMM301DLTJJ.49.33.C11.1.454.light.4.raw
agtcgagagacacgaccggtgctcgatttagagtgagctcgttgggtttgggctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagatttgcagtttattactgtcagcagtataatgtccgggctccggacactttcggcggagggaccaaggtggagatcaaacgaa

SEQ ID NO: 567939 - DNA, 497 bp, Homo sapiens
  misc_feature: HIJSMM301DIPSJ.17.40.D07.1.454.light.4.raw
cgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggatccctgatcggttctctggctccgtcgacagttcctccaactctgcctccctcaccatctctggactgacgactgaggacgagggtgactactactgtcactcttatgatgacattttatgaggcgatattcggcggagggacaaaaggtgaccgtgctaggtcagaccccg

SEQ ID NO: 567940 - DNA, 511 bp, Homo sapiens
  misc_feature: HIJSMM301BXEG4.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggtcgccactctcgtggttttcggcggaggcaccgaagtgaccgtcctcggtcagccaaggctgcccctcggtcactc

SEQ ID NO: 567941 - DNA, 492 bp, Homo sapiens; identical to SEQ ID NO: 537666
  misc_feature: HIJSMM301DI9HK.43.33.C11.1.454.light.4.raw

SEQ ID NO: 567942 - DNA, 506 bp, Homo sapiens; identical to SEQ ID NO: 535058
  misc_feature: HIJSMM301AN3PY.17.41.D08.1.454.light.4.raw

SEQ ID NO: 567943 - DNA, 505 bp, Homo sapiens
  misc_feature: HIJSMM301BZ00U.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctcgccccctcggtcac

SEQ ID NO: 567944 - DNA, 485 bp, Homo sapiens
  misc_feature: HIJSMM301C4NMP.47.78.H01.1.454.light.4.raw
  modified_base (306)..(306): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacncctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 567945 - DNA, 497 bp, Homo sapiens; identical to SEQ ID NO: 559114
  misc_feature: HIJSMM301BLRQD.51.5.A05.1.454.light.4.raw

SEQ ID NO: 567946 - DNA, 485 bp, Homo sapiens; identical to SEQ ID NO: 538787
  misc_feature: HIJSMM301EWY4Z.49.57.F02.1.454.light.4.raw

SEQ ID NO: 567947 - DNA, 504 bp, Homo sapiens; identical to SEQ ID NO: 535561
  misc_feature: HIJSMM301EB5TM.4.57.F02.1.454.light.4.raw

SEQ ID NO: 567948 - DNA, 478 bp, Homo sapiens
  misc_feature: HIJSMM301ECHZF.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttacaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 567949 - DNA, 504 bp, Homo sapiens
  misc_feature: HIJSMM301DQS1P.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagccaaggctgccccctcggt

SEQ ID NO: 567950 - DNA, 481 bp, Homo sapiens
  misc_feature: HIJSMM301AKW04.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccaccctccctccgtgtctgat

SEQ ID NO: 567951 - DNA, 504 bp, Homo sapiens
  misc_feature: HIJSMM301BI1RL.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccatggctgccccctcggtcactcttcg

SEQ ID NO: 567952 - DNA, 512 bp, Homo sapiens
  misc_feature: HIJSMM301CDNKJ.4.28.C06.1.454.light.4.raw
agcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctgggtcagcccaaggctgccccctcggtcactctgttcccaccctcctccta

SEQ ID NO: 567953 - DNA, 494 bp, Homo sapiens; identical to SEQ ID NO: 534992
  misc_feature: HIJSMM301BMCAM.9.1.A01.1.454.light.4.raw

SEQ ID NO: 567954 - DNA, 486 bp, Homo sapiens; identical to SEQ ID NO: 535385
  misc_feature: HIJSMM301EYYHN.19.71.G05.1.454.light.4.raw

SEQ ID NO: 567955 - DNA, 496 bp, Homo sapiens
  misc_feature: HIJSMM301BW98V.51.71.G05.1.454.light.4.raw
  modified_base (490)..(490): a, c, t, g, unknown or other
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacctaccncgtcta

SEQ ID NO: 567956 - DNA, 500 bp, Homo sapiens
  misc_feature: HIJSMM301ERS1W.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgaggggacacgccctggagattaaacgaactgtggctgcaccat

SEQ ID NO: 567957 - DNA, 486 bp, Homo sapiens
  misc_feature: HIJSMM301EGN3F.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccagggaccaagctggagatcacaggaactgtggctgcacc

SEQ ID NO: 567958 - DNA, 525 bp, Homo sapiens
  misc_feature: HIJSMM301EC64I.47.53.E09.1.454.light.4.raw
  modified_base (474)..(474): a, c, t, g, unknown or other
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagccgacgtcctcggtcgngaccaacggcgtcgcccctccggtcgactctcgttcctccctcctcctacg

SEQ ID NO: 567959 - DNA, 471 bp, Homo sapiens
  misc_feature: HIJSMM301DWF3J.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactacccaatcacttcgcctggactgaagtgcatatgaagagaactgtggctgca

SEQ ID NO: 567960 - DNA, 490 bp, Homo sapiens
  misc_feature: HIJSMM301EDCAU.19.71.G05.1.454.light.4.raw
  modified_base (476)..(476): a, c, t, g, unknown or other
  modified_base (480)..(480): a, c, t, g, unknown or other
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgtcgcgacggacgaagtagagtanctanacgaatagtg

SEQ ID NO: 567961 - DNA, 503 bp, Homo sapiens; identical to SEQ ID NO: 535140
  misc_feature: HIJSMM301C8TXP.18.37.D04.1.454.light.4.raw

SEQ ID NO: 567962 - DNA, 500 bp, Homo sapiens
  misc_feature: HIJSMM301COTBH.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggtgcccctccggtcgactctcgttccgtccctcctccgacgtgcgtcgt

SEQ ID NO: 567963 - DNA, 494 bp, Homo sapiens
  misc_feature: HIJSMM301AMG5X.4.22.B11.1.454.light.4.raw
agcactgtagcacgaccggtgctcgatttagacgacagctcaggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggtcaggggaccaagctggagatcaaacgaactgtggctgcaccatctgtctt

SEQ ID NO: 567964 - DNA, 416 bp, Homo sapiens; identical to SEQ ID NO: 566478
  misc_feature: HIJSMM301EBG33.18.59.F04.1.454.light.4.raw

SEQ ID NO: 567965 - DNA, 484 bp, Homo sapiens
  misc_feature: HIJSMM301ECE5Y.48.77.G11.1.454.light.4.raw
agtatacatacacgaccggtgctcgatttagctagtcactcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacga

SEQ ID NO: 567966 - DNA, 510 bp, Homo sapiens; identical to SEQ ID NO: 542037
  misc_feature: HIJSMM301AWHMB.4.57.F02.1.454.light.4.raw

SEQ ID NO: 567967 - DNA, 498 bp, Homo sapiens; identical to SEQ ID NO: 537020
  misc_feature: HIJSMM301D9XUE.26.26.C04.1.454.light.4.raw

SEQ ID NO: 567968 - DNA, 488 bp, Homo sapiens; identical to SEQ ID NO: 535512
  misc_feature: HIJSMM301CMV37.12.51.E07.1.454.light.4.raw

SEQ ID NO: 567969 - DNA, 495 bp, Homo sapiens
  misc_feature: HIJSMM301BJOD9.52.45.E01.1.454.light.4.raw
cgcagtacgacacgaccggtgctcgatttagtgagtcagtaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtctttggtcttcggactgggaccaaggtcaccgtcctaggtcacg

SEQ ID NO: 567970 - DNA, 491 bp, Homo sapiens; identical to SEQ ID NO: 542796
  misc_feature: HIJSMM301DOCPU.19.57.F02.1.454.light.4.raw

SEQ ID NO: 567971 - DNA, 518 bp, Homo sapiens
  misc_feature: HIJSMM301BHT4L.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctcgttcccaccctcctccacg

SEQ ID NO: 567972 - DNA, 492 bp, Homo sapiens
  misc_feature: HIJSMM301DDPJ0.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccagggaccaagctcgagatcaaacgaactgtggctgcaccatctgtcttcatcttcccg

SEQ ID NO: 567973 - DNA, 494 bp, Homo sapiens; identical to SEQ ID NO: 534992
  misc_feature: HIJSMM301EXCY6.9.1.A01.1.454.light.4.raw

SEQ ID NO: 567974 - DNA, 419 bp, Homo sapiens; identical to SEQ ID NO: 557533
  misc_feature: HIJSMM301D0E6W.18.59.F04.1.454.light.4.raw

SEQ ID NO: 567975 - DNA, 507 bp, Homo sapiens
  misc_feature: HIJSMM301C2YFZ.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttctatcttcccgccat

SEQ ID NO: 567976 - DNA, 483 bp, Homo sapiens; identical to SEQ ID NO: 536202
  misc_feature: HIJSMM301CASY4.43.24.C02.1.454.light.4.raw

SEQ ID NO: 567977 - DNA, 503 bp, Homo sapiens; identical to SEQ ID NO: 550542
  misc_feature: HIJSMM301BOFO0.2.76.G10.1.454.light.4.raw

SEQ ID NO: 567978 - DNA, 494 bp, Homo sapiens
  misc_feature: HIJSMM301AMA2Z.49.33.C11.1.454.light.4.raw
agtcgagagacacgaccggtgctcgatttagagtgagctcgttgggtttggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaagggtggaggatcaaacgaactagtggctgcaccat

SEQ ID NO: 567979 - DNA, 489 bp, Homo sapiens; identical to SEQ ID NO: 535139
  misc_feature: HIJSMM301AW6NU.14.55.E11.1.454.light.4.raw

SEQ ID NO: 567980 - DNA, 473 bp, Homo sapiens; identical to SEQ ID NO: 536488
  misc_feature: HIJSMM301BYIWS.12.49.E05.1.454.light.4.raw

SEQ ID NO: 567981 - DNA, 517 bp, Homo sapiens
  misc_feature: HIJSMM301ALJMK.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctggtgggcaggtcagcccaaggccaacccactgtcactcttcg

SEQ ID NO: 567982 - DNA, 517 bp, Homo sapiens
  misc_feature: HIJSMM301C1NJI.8.23.C01.1.454.light.4.raw
ctcgcgtgtccacgaccggtgctcgatttagtacacgtgattagggattggggcgtgggcctcaggaagcagcatcgggggtgccgcagccatggccctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtccaccgtcctaggtcagcccaaggccaaccccactgtcactctgttcccaccctcctcga

SEQ ID NO: 567983 - DNA, 497 bp, Homo sapiens
  misc_feature: HIJSMM301EVSXE.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggcctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcacgcggcagtggatcgtgggacagaattcactctcactatcaccagcctgcaacctgatgattttgctaacttattactgccaacagtatcatcatcattgtaatttcggtggtagggaccgaaggtggaggtcaaacgaactgtggctgcaccatctgtcttcatt

SEQ ID NO: 567984 - DNA, 486 bp, Homo sapiens
  misc_feature: HIJSMM301BWGZS.43.73.G07.1.454.light.4.raw
tgtgagtagtcacgaccggtgctcgatttagctctacgctcagggcacgaccggtgctcgatttagctctacgctcaggggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatgggcatccctgatcggttctcagtcttgggctcaggcctgactcggtccctgaccatcaacaacatccaggaagaggatgacagtgactactactgtgggacgaattatggcagtggaatacctaca

SEQ ID NO: 567985 - DNA, 484 bp, Homo sapiens; identical to SEQ ID NO: 535400
  misc_feature: HIJSMM301EC3QQ.46.26.C04.1.454.light.4.raw

SEQ ID NO: 567986 - DNA, 514 bp, Homo sapiens
  misc_feature: HIJSMM301B37CH.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgtcccaccctcctcg

SEQ ID NO: 567987 - DNA, 496 bp, Homo sapiens; identical to SEQ ID NO: 551939
  misc_feature: HIJSMM301CRB17.19.71.G05.1.454.light.4.raw

SEQ ID NO: 567988 - DNA, 489 bp, Homo sapiens
  misc_feature: HIJSMM301BU52W.43.53.E09.1.454.light.4.raw
tgtgagtagtcacgaccggtgctcgatttagagagagtgtgttgggtttggggactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaa

SEQ ID NO: 567989 - DNA, 486 bp, Homo sapiens
  misc_feature: HIJSMM301C0PDI.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaaggacacgaactggagattaaacgaaactgtggctgcacca

SEQ ID NO: 567990 - DNA, 517 bp, Homo sapiens
  misc_feature: HIJSMM301BNIHJ.52.34.D01.1.454.light.4.raw
cgcagtacgacacgaccggtgctcgatttagatcgtctgtgttgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactgtggctgcaccatcctgtcttcatcttccccg

SEQ ID NO: 567991 - DNA, 495 bp, Homo sapiens; identical to SEQ ID NO: 535007
  misc_feature: HIJSMM301AIYGO.22.5.A05.1.454.light.4.raw

SEQ ID NO: 567992 - DNA, 509 bp, Homo sapiens; identical to SEQ ID NO: 543266
  misc_feature: HIJSMM301C6RCL.17.33.C11.1.454.light.4.raw

SEQ ID NO: 567993 - DNA, 485 bp, Homo sapiens
  misc_feature: HIJSMM301ALA3C.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagtacatatctaccacttacgttcgacggacggacgacgtcgtagtatactacgaacgaaccgtaagtggt

SEQ ID NO: 567994 - DNA, 422 bp, Homo sapiens; identical to SEQ ID NO: 538836
  misc_feature: HIJSMM301DV5DL.41.14.B03.1.454.light.4.raw

SEQ ID NO: 567995 - DNA, 494 bp, Homo sapiens; identical to SEQ ID NO: 534992
  misc_feature: HIJSMM301CKPSI.9.1.A01.1.454.light.4.raw

SEQ ID NO: 567996 - DNA, 497 bp, Homo sapiens
  misc_feature: HIJSMM301AYEFM.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttcta

SEQ ID NO: 567997 - DNA, 502 bp, Homo sapiens
  misc_feature: HIJSMM301DCEYZ.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaaccccactgtccactctcgttcccaccctcctcgtactctctcg

SEQ ID NO: 567998 - DNA, 473 bp, Homo sapiens
  misc_feature: HIJSMM301ESKZL.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctctcgctacgtaga

SEQ ID NO: 567999 - DNA, 504 bp, Homo sapiens; identical to SEQ ID NO: 536385
  misc_feature: HIJSMM301CPSNS.27.78.H01.1.454.light.4.raw

SEQ ID NO: 568000 - DNA, 485 bp, Homo sapiens
  misc_feature: HIJSMM301C85S0.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 568001 - DNA, 521 bp, Homo sapiens; identical to SEQ ID NO: 539470
  misc_feature: HIJSMM301EJ3PI.27.23.C01.1.454.light.4.raw

SEQ ID NO: 568002 - DNA, 496 bp, Homo sapiens; identical to SEQ ID NO: 535109
  misc_feature: HIJSMM301B041F.16.78.H01.1.454.light.4.raw

SEQ ID NO: 568003 - DNA, 484 bp, Homo sapiens
  misc_feature: HIJSMM301CVGW3.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaaactgtggctgcacc

SEQ ID NO: 568004 - DNA, 523 bp, Homo sapiens
  misc_feature: HIJSMM301AP1R7.53.80.H03.1.454.light.4.raw
cgcgtatacacacgaccggtgctcgatttagctgtgcgtcgaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatggcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtctaggtcagcccaaggctgccccctcggtcactctgttcccaccctcctctcg

SEQ ID NO: 568005 - DNA, 447 bp, Homo sapiens
  misc_feature: HIJSMM301D6QD0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtacaagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 568006 - DNA, 502 bp, Homo sapiens
  misc_feature: HIJSMM301BTP7R.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactagtggctgcaccatctgtcttcatcttcccgccta

SEQ ID NO: 568007 - DNA, 490 bp, Homo sapiens; identical to SEQ ID NO: 543909
  misc_feature: HIJSMM301B298V.14.55.E11.1.454.light.4.raw

SEQ ID NO: 568008 - DNA, 478 bp, Homo sapiens
  misc_feature: HIJSMM301A8DEG.12.19.B08.1.454.light.4.raw
atacgacgtacacgaccggtgctcgatttagtgagtcagtaaggggcctgaagactttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgcaaagtgggtcccatcaaggttcagtggcagtggatctgggacagatttcactctcaccatcagcggtctgcaacctgaagattttgcaacttacttctgtcaacagagttacaatacccctccgtcacctgcggccaagggacacgg

SEQ ID NO: 568009 - DNA, 499 bp, Homo sapiens
  misc_feature: HIJSMM301DKZA8.47.64.F09.1.454.light.4.raw
agctcacgtacacgaccggtgctcgatttagcgcgtatacaagggggaggaacgtgctcagttaggacccagagggaaccatggaagccccagctcagcttctcttcctcctgctactctggctcccagataccatcgggagaagttgtgttgacacagtctccagccaccctgtctttgtctccgaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgcgtcactttcggcggagggaccgagggtggagatcaaacgaactgtggctgcaccatctgtcttccatt

SEQ ID NO: 568010 - DNA, 503 bp, Homo sapiens
  misc_feature: HIJSMM301ETXWM.9.12.B01.1.454.light.4.raw
tgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaaactagtggctgcaccatctgtcttcta

SEQ ID NO: 568011 - DNA, 488 bp, Homo sapiens
  misc_feature: HIJSMM301CFXRK.49.20.B09.1.454.light.4.raw
agtcgagagacacgaccggtgctcgatttagtgtagtgtgaagggcttgatgccttggggtgggaggagagacccctcccctgggatcctgcagctctagtctcccgtggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagtta

SEQ ID NO: 568012 - DNA, 463 bp, Homo sapiens; identical to SEQ ID NO: 535008
  misc_feature: HIJSMM301BAPEK.10.9.A09.1.454.light.4.raw

SEQ ID NO: 568013 - DNA, 490 bp, Homo sapiens
  misc_feature: HIJSMM301AREOQ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctactcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctcgg

SEQ ID NO: 568014 - DNA, 354 bp, Homo sapiens; identical to SEQ ID NO: 535026
  misc_feature: HIJSMM301BIY50.19.22.B11.1.454.light.4.raw

SEQ ID NO: 568015 - DNA, 485 bp, Homo sapiens
  misc_feature: HIJSMM301AT6J1.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctcactgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtt

SEQ ID NO: 568016 - DNA, 517 bp, Homo sapiens; identical to SEQ ID NO: 543501
  misc_feature: HIJSMM301BPUK1.47.53.E09.1.454.light.4.raw

SEQ ID NO: 568017 - DNA, 472 bp, Homo sapiens; identical to SEQ ID NO: 535898
  misc_feature: HIJSMM301CWC80.15.8.A08.1.454.light.4.raw

SEQ ID NO: 568018 - DNA, 485 bp, Homo sapiens; identical to SEQ ID NO: 535688
  misc_feature: HIJSMM301EJJZC.19.5.A05.1.454.light.4.raw

SEQ ID NO: 568019 - DNA, 509 bp, Homo sapiens; identical to SEQ ID NO: 539359
  misc_feature: HIJSMM301CRUEN.47.85.H08.1.454.light.4.raw

SEQ ID NO: 568020 - DNA, 497 bp, Homo sapiens
  misc_feature: HIJSMM301ATWK9.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcacca

SEQ ID NO: 568021 - DNA, 510 bp, Homo sapiens; identical to SEQ ID NO: 535855
  misc_feature: HIJSMM301AEE6J.17.33.C11.1.454.light.4.raw

SEQ ID NO: 568022 - DNA, 486 bp, Homo sapiens; identical to SEQ ID NO: 535385
  misc_feature: HIJSMM301CN1TW.19.71.G05.1.454.light.4.raw

SEQ ID NO: 568023 - DNA, 503 bp, Homo sapiens; identical to SEQ ID NO: 540136
  misc_feature: HIJSMM301AHVD9.19.10.A10.1.454.light.4.raw

SEQ ID NO: 568024 - DNA, 503 bp, Homo sapiens
  misc_feature: HIJSMM301DUE9O.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgtaactcgcttcttctggctccaagtctggcgacacggcctccctgaccatctctgggctccaggctgaagacgaggctgattattactgcagctcatatacaggcagcagcactcaggttttcgggcgagggaccaagctgaccgtcctaggtcagcccaaggctcgccccctcggt

SEQ ID NO: 568025 - DNA, 507 bp, Homo sapiens
  misc_feature: HIJSMM301APT6D.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatctcccgccact

SEQ ID NO: 568026 - DNA, 500 bp, Homo sapiens
  misc_feature: HIJSMM301CFERX.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggcagcccaa

SEQ ID NO: 568027 - DNA, 523 bp, Homo sapiens
  misc_feature: HIJSMM301EC8L2.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctcccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 568028 - DNA, 475 bp, Homo sapiens
  misc_feature: HIJSMM301DIXT8.3.1.A01.1.454.light.4.raw
agacgcactccacgaccggtgctcgatttagacgtctcatcagggcacgaccggtgctcgatttagacgtctcatcaggggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttgccaggaccaag

SEQ ID NO: 568029 - DNA, 495 bp, Homo sapiens; identical to SEQ ID NO: 542416
  misc_feature: HIJSMM301DSCAF.27.78.H01.1.454.light.4.raw

SEQ ID NO: 568030 - DNA, 497 bp, Homo sapiens; identical to SEQ ID NO: 535664
  misc_feature: HIJSMM301BV3C3.22.14.B03.1.454.light.4.raw

SEQ ID NO: 568031 - DNA, 480 bp, Homo sapiens
  misc_feature: HIJSMM301AIG1T.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactagtgg

SEQ ID NO: 568032 - DNA, 494 bp, Homo sapiens; identical to SEQ ID NO: 534994
  misc_feature: HIJSMM301C056Y.27.78.H01.1.454.light.4.raw

SEQ ID NO: 568033 - DNA, 490 bp, Homo sapiens; identical to SEQ ID NO: 539113
  misc_feature: HIJSMM301DKCL7.15.8.A08.1.454.light.4.raw

SEQ ID NO: 568034 - DNA, 493 bp, Homo sapiens
  misc_feature: HIJSMM301ET35B.27.78.H01.1.454.light.4.raw
  modified_base (426)..(426): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactggagattaaacgaactgtggctgcacatctgtctt

SEQ ID NO: 568035 - DNA, 468 bp, Homo sapiens; identical to SEQ ID NO: 557585
  misc_feature: HIJSMM301AM96N.49.27.C05.1.454.light.4.raw

SEQ ID NO: 568036 - DNA, 454 bp, Homo sapiens; identical to SEQ ID NO: 534964
  misc_feature: HIJSMM301AYKWU.19.86.H09.1.454.light.4.raw

SEQ ID NO: 568037 - DNA, 498 bp, Homo sapiens
  misc_feature: HIJSMM301C4Q6L.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccaaggtggaaatacaaacgaactagtggctgcacca

SEQ ID NO: 568038 - DNA, 506 bp, Homo sapiens; identical to SEQ ID NO: 545155
  misc_feature: HIJSMM301EZ7N5.9.12.B01.1.454.light.4.raw

SEQ ID NO: 568039 - DNA, 519 bp, Homo sapiens
  misc_feature: HIJSMM301BX6GZ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccacct

SEQ ID NO: 568040 - DNA, 507 bp, Homo sapiens; identical to SEQ ID NO: 558669
  misc_feature: HIJSMM301AWR22.21.22.B11.1.454.light.4.raw

SEQ ID NO: 568041 - DNA, 490 bp, Homo sapiens; identical to SEQ ID NO: 551019
  misc_feature: HIJSMM301A7H5H.48.37.D04.1.454.light.4.raw

SEQ ID NO: 568042 - DNA, 504 bp, Homo sapiens
  misc_feature: HIJSMM301B8PX4.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccttcctgggtcagcccaaggctcgccccctcggt

SEQ ID NO: 568043 - DNA, 484 bp, Homo sapiens; identical to SEQ ID NO: 544689
  misc_feature: HIJSMM301B6LOV.22.6.A06.1.454.light.4.raw

SEQ ID NO: 568044 - DNA, 492 bp, Homo sapiens; identical to SEQ ID NO: 535939
  misc_feature: HIJSMM301AR29D.13.5.A05.1.454.light.4.raw

SEQ ID NO: 568045 - DNA, 505 bp, Homo sapiens; identical to SEQ ID NO: 567186
  misc_feature: HIJSMM301B829Q.9.71.G05.1.454.light.4.raw

SEQ ID NO: 568046 - DNA, 496 bp, Homo sapiens
  misc_feature: HIJSMM301DVW3L.51.27.C05.1.454.light.4.raw
cgatcgtatacacgaccggtgctcgatttagacgcgatcgaagggtttggggtgggcctcaggaagcagcatcggaggtgcctcagccatggcatggatccctctcttcctcggcgtccttgcttactgcacaggatttgtggcctcctatgagctgactcggccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcactctcg

SEQ ID NO: 568047 - DNA, 517 bp, Homo sapiens; identical to SEQ ID NO: 557801
  misc_feature: HIJSMM301ARL0O.40.87.H10.1.454.light.4.raw

SEQ ID NO: 568048 - DNA, 497 bp, Homo sapiens; identical to SEQ ID NO: 536371
  misc_feature: HIJSMM301DD89M.16.78.H01.1.454.light.4.raw

SEQ ID NO: 568049 - DNA, 485 bp, Homo sapiens
  misc_feature: HIJSMM301COGAO.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcttggtcagcccaaggctgcccccg

SEQ ID NO: 568050 - DNA, 486 bp, Homo sapiens
  misc_feature: HIJSMM301BMWAA.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcgcggagggaccaaggtggagatcaaacgaactgt

SEQ ID NO: 568051 - DNA, 479 bp, Homo sapiens
  misc_feature: HIJSMM301DYCD5.16.81.H04.1.454.light.4.raw
tgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtgtctgcacc

SEQ ID NO: 568052 - DNA, 497 bp, Homo sapiens
  misc_feature: HIJSMM301EO86D.40.37.D04.1.454.light.4.raw
tctagcgactcacgaccggtgctcgatttagtagcatactgttggggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagccaaggctcg

SEQ ID NO: 568053 - DNA, 500 bp, Homo sapiens
  misc_feature: HIJSMM301BFPUB.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccgaagctgaccgtcctaggtcagcccaacggctgccccctcggt

SEQ ID NO: 568054 - DNA, 475 bp, Homo sapiens
  misc_feature: HIJSMM301CXK23.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcgcggagggaccaaggtggagatcaaacgaactgtggctgca

SEQ ID NO: 568055 - DNA, 493 bp, Homo sapiens
  misc_feature: HIJSMM301BQMEQ.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgactggtgctgcacatctgtctcatctcccgcatctgacta

SEQ ID NO: 568056 - DNA, 508 bp, Homo sapiens
  misc_feature: HIJSMM301DVH2W.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgtttttttcggcggtcgggaccaagctgaccgtcctaggtcagcccaaggctgccccctcggtcta

SEQ ID NO: 568057 - DNA, 508 bp, Homo sapiens; identical to SEQ ID NO: 536062
  misc_feature: HIJSMM301CJJPM.11.57.F02.1.454.light.4.raw

SEQ ID NO: 568058 - DNA, 511 bp, Homo sapiens
  misc_feature: HIJSMM301A9716.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccgt

SEQ ID NO: 568059 - DNA, 492 bp, Homo sapiens
  misc_feature: HIJSMM301CZSUG.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaaggtggaggtcaaacgaactgtggctgcaccatctgtcttcatt

SEQ ID NO: 568060 - DNA, 492 bp, Homo sapiens
  misc_feature: HIJSMM301DGEVG.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatacaaacgaactgtggctgcacatcttcg

SEQ ID NO: 568061 - DNA, 475 bp, Homo sapiens
  misc_feature: HIJSMM301AG2JG.17.67.G01.1.454.light.4.raw
cgtagactagcacgaccggtgctcgatttagagtatacatattgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcgccgagggaccgagggtggaaagtacaaacgaa

SEQ ID NO: 568062 - DNA, 494 bp, Homo sapiens; identical to SEQ ID NO: 536463
  misc_feature: HIJSMM301DNPY0.22.57.F02.1.454.light.4.raw

SEQ ID NO: 568063 - DNA, 492 bp, Homo sapiens; identical to SEQ ID NO: 541122
  misc_feature: HIJSMM301CL1NN.49.66.F11.1.454.light.4.raw

SEQ ID NO: 568064 - DNA, 496 bp, Homo sapiens
  misc_feature: HIJSMM301C1UZ9.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactagtggctgcaccatctgtcttcat

SEQ ID NO: 568065 - DNA, 456 bp, Homo sapiens
  misc_feature: HIJSMM301EQ9J1.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcaagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctccctccacgagagta

SEQ ID NO: 568066 - DNA, 494 bp, Homo sapiens; identical to SEQ ID NO: 535276
  misc_feature: HIJSMM301D5AD5.16.6.A06.1.454.light.4.raw

SEQ ID NO: 568067 - DNA, 509 bp, Homo sapiens
  misc_feature: HIJSMM301DMIVM.48.27.C05.1.454.light.4.raw
agtatacatacacgaccggtgctcgatttagacgcgatcgaagggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatgtcaatcgaactgtggctgcaccatctgtcttcatcttccccg

SEQ ID NO: 568068 - DNA, 482 bp, Homo sapiens; identical to SEQ ID NO: 535216
  misc_feature: HIJSMM301EBM6N.17.26.C04.1.454.light.4.raw

SEQ ID NO: 568069 - DNA, 495 bp, Homo sapiens
  misc_feature: HIJSMM301BCXSZ.5.12.B01.1.454.light.4.raw
atcagacacgcacgaccggtgctcgatttagtagtgtagattccgcgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctcg

SEQ ID NO: 568070 - DNA, 493 bp, Homo sapiens; identical to SEQ ID NO: 539015
  misc_feature: HIJSMM301DRFH2.27.78.H01.1.454.light.4.raw

SEQ ID NO: 568071 - DNA, 508 bp, Homo sapiens
  misc_feature: HIJSMM301DY7NV.41.30.C08.1.454.light.4.raw
  modified_base (502)..(502): a, c, t, g, unknown or other
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggatcttcggaactgggaccagggtcacgtcctaggtcagcccaaggccaaccccacngtcact

SEQ ID NO: 568072 - DNA, 502 bp, Homo sapiens; identical to SEQ ID NO: 557696
  misc_feature: HIJSMM301B5ZXZ.22.15.B04.1.454.light.4.raw

SEQ ID NO: 568073 - DNA, 447 bp, Homo sapiens
  misc_feature: HIJSMM301B9EL8.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccgaaggctcgccccctcggtcactctcgttcccgccctcctcagacgtatca

SEQ ID NO: 568074 - DNA, 488 bp, Homo sapiens
  misc_feature: HIJSMM301ELQ63.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaacgaactgtggctgcaccatctgtcttcat

SEQ ID NO: 568075 - DNA, 510 bp, Homo sapiens
  misc_feature: HIJSMM301BPZVJ.4.71.G05.1.454.light.4.raw
  modified_base (418)..(418): a, c, t, g, unknown or other
  modified_base (445)..(445): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaataganaacagtgataatttctgggtgttcggnggagggaccaaactgaccgtcctaggtcagcccaaggctcgccccctcggtcactctgttccccg

SEQ ID NO: 568076 - DNA, 489 bp, Homo sapiens; identical to SEQ ID NO: 545019
  misc_feature: HIJSMM301DEYJC.19.57.F02.1.454.light.4.raw

SEQ ID NO: 568077 - DNA, 447 bp, Homo sapiens; identical to SEQ ID NO: 535020
  misc_feature: HIJSMM301BKPNE.18.9.A09.1.454.light.4.raw

SEQ ID NO: 568078 - DNA, 507 bp, Homo sapiens; identical to SEQ ID NO: 535641
  misc_feature: HIJSMM301CAYX4.10.88.H11.1.454.light.4.raw

SEQ ID NO: 568079 - DNA, 501 bp, Homo sapiens
  misc_feature: HIJSMM301CCSH1.48.68.G02.1.454.light.4.raw
  modified_base (397)..(397): a, c, t, g, unknown or other
  modified_base (402)..(402): a, c, t, g, unknown or other
agtatacatacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctnttacngtcatcagacttttagttacgtcggaccttcggccaagggacacgactggagattaaacgaactgtggctgcaccatctgtcttcactcttcccgccta

SEQ ID NO: 568080 - DNA, 514 bp, Homo sapiens; identical to SEQ ID NO: 542046
  misc_feature: HIJSMM301B4EXW.43.23.C01.1.454.light.4.raw

SEQ ID NO: 568081 - DNA, 525 bp, Homo sapiens
  misc_feature: HIJSMM301B20QB.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgagtagtaca

SEQ ID NO: 568082 - DNA, 500 bp, Homo sapiens
  misc_feature: HIJSMM301BNTN9.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaac

SEQ ID NO: 568083 - DNA, 506 bp, Homo sapiens
  misc_feature: HIJSMM301D14E3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggcgtgcaccatctgtcttcatcttccccg

SEQ ID NO: 568084 - DNA, 489 bp, Homo sapiens
  misc_feature: HIJSMM301CIRZS.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaaggtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcggccaagggaccaaggtggatatcagacgaa

SEQ ID NO: 568085 - DNA, 521 bp, Homo sapiens; identical to SEQ ID NO: 538715
  misc_feature: HIJSMM301E0WCF.27.23.C01.1.454.light.4.raw

SEQ ID NO: 568086 - DNA, 499 bp, Homo sapiens
  misc_feature: HIJSMM301E1IAD.22.27.C05.1.454.light.4.raw
  modified_base (436)..(436): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattanattcctcctcagacgttcggccaagggaccaaggtggaaatcaaacgaactgtggctgcacca

SEQ ID NO: 568087 - DNA, 506 bp, Homo sapiens; identical to SEQ ID NO: 539303
  misc_feature: HIJSMM301CHVT4.8.19.B08.1.454.light.4.raw

SEQ ID NO: 568088 - DNA, 485 bp, Homo sapiens; identical to SEQ ID NO: 538533
  misc_feature: HIJSMM301EIWSK.47.78.H01.1.454.light.4.raw

SEQ ID NO: 568089 - DNA, 513 bp, Homo sapiens
  misc_feature: HIJSMM301C42SA.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgacggatgaggctgatttattactgtgcaccgtgggatgacatcctgaatggttccggtgttcggcggagggaccaggctgaccgtcctaagtcagcccaaggctcgccccctc

SEQ ID NO: 568090 - DNA, 501 bp, Homo sapiens
  misc_feature: HIJSMM301BXCDW.43.25.C03.1.454.light.4.raw
tgtgagtagtcacgaccggtgctcgatttagtagtgtagatttgggtttggggtgatcaggactcctcagttcaccttctcacaatgaggcgtccctgctacgagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcacca

SEQ ID NO: 568091 - DNA, 512 bp, Homo sapiens
  misc_feature: HIJSMM301BBOVN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctggacgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaacggtaggaaagtacaaacgaacctagtggcgtgcaccatctgtcttctatcttccccg

SEQ ID NO: 568092 - DNA, 480 bp, Homo sapiens
  misc_feature: HIJSMM301AWGRN.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcac

SEQ ID NO: 568093 - DNA, 491 bp, Homo sapiens
  misc_feature: HIJSMM301CKAFV.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggcctggaccaaagtggatttcagacgaactgtggtctgcaccatctgtcttcta

SEQ ID NO: 568094 - DNA, 493 bp, Homo sapiens; identical to SEQ ID NO: 535745
  misc_feature: HIJSMM301AOR2O.47.78.H01.1.454.light.4.raw

SEQ ID NO: 568095 - DNA, 495 bp, Homo sapiens
  misc_feature: HIJSMM301BD9N4.43.34.D01.1.454.light.4.raw
tgtgagtagtcacgaccggtgctcgatttagatcgtctgtgttgggtttggggggagtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaa

SEQ ID NO: 568096 - DNA, 509 bp, Homo sapiens; identical to SEQ ID NO: 568067
  misc_feature: HIJSMM301BB85E.48.27.C05.1.454.light.4.raw

SEQ ID NO: 568097 - DNA, 484 bp, Homo sapiens; identical to SEQ ID NO: 535400
  misc_feature: HIJSMM301DTVY5.46.26.C04.1.454.light.4.raw

SEQ ID NO: 568098 - DNA, 504 bp, Homo sapiens
  misc_feature: HIJSMM301CN8AT.19.78.H01.1.454.light.4.raw
tactctcgtgcacgaccggtgctcgatttagtgtgagtagtttgggtttgggggctttatttgggctctgctgctcctcactctcctcactcaggacacagggtcctggacccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtccaccgtcctaggtcagcccaaggcccaaccccactgtcactctcgttccccgccctcctccacgagagta

SEQ ID NO: 568099 - DNA, 486 bp, Homo sapiens
  misc_feature: HIJSMM301AD37V.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatacaaacgaact

SEQ ID NO: 568100 - DNA, 507 bp, Homo sapiens; identical to SEQ ID NO: 544788
  misc_feature: HIJSMM301AVX27.16.46.E02.1.454.light.4.raw

SEQ ID NO: 568101 - DNA, 493 bp, Homo sapiens; identical to SEQ ID NO: 535566
  misc_feature: HIJSMM301DKQFK.16.6.A06.1.454.light.4.raw

SEQ ID NO: 568102 - DNA, 496 bp, Homo sapiens
  misc_feature: HIJSMM301DF7QD.40.58.F03.1.454.light.4.raw
tctagcgactcacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgcgacgttcgccggggcaacgtggaatcaaacgaactagtggctgcaccat

SEQ ID NO: 568103 - DNA, 486 bp, Homo sapiens; identical to SEQ ID NO: 549897
  misc_feature: HIJSMM301EH08C.14.55.E11.1.454.light.4.raw

SEQ ID NO: 568104 - DNA, 486 bp, Homo sapiens; identical to SEQ ID NO: 535290
  misc_feature: HIJSMM301A4YIF.3.12.B01.1.454.light.4.raw

SEQ ID NO: 568105 - DNA, 446 bp, Homo sapiens; identical to SEQ ID NO: 539491
  misc_feature: HIJSMM301D8I97.18.9.A09.1.454.light.4.raw

SEQ ID NO: 568106 - DNA, 514 bp, Homo sapiens
  misc_feature: HIJSMM301AYH4O.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaacgggaccgaacggtagggaaatactaaacgaaactagtggctgcaccatctgtcttctatcttccccg

SEQ ID NO: 568107 - DNA, 511 bp, Homo sapiens
  misc_feature: HIJSMM301D8CE8.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgagacagacttcactctcaccatcatcagcctggagcctgaagatgttgcagtttattactgtcaacatcgtaccgagtggccgtccgggggcctactttccggcccgtcgggaccaaggtggagatcaaacgaactgtggctgcacatctgtctt

SEQ ID NO: 568108 - DNA, 490 bp, Homo sapiens; identical to SEQ ID NO: 543909
  misc_feature: HIJSMM301BHFJ6.14.55.E11.1.454.light.4.raw

SEQ ID NO: 568109 - DNA, 501 bp, Homo sapiens
  misc_feature: HIJSMM301B8JSO.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacttcggccaagggacagactggagattaaacg

SEQ ID NO: 568110 - DNA, 486 bp, Homo sapiens; identical to SEQ ID NO: 535043
  misc_feature: HIJSMM301C8PCR.46.35.D02.1.454.light.4.raw

SEQ ID NO: 568111 - DNA, 500 bp, Homo sapiens
  misc_feature: HIJSMM301DOW2M.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctgggtcagcccaagggctgccccctcggtcactctgtt

SEQ ID NO: 568112 - DNA, 496 bp, Homo sapiens; identical to SEQ ID NO: 538625
  misc_feature: HIJSMM301A26EO.2.49.E05.1.454.light.4.raw

SEQ ID NO: 568113 - DNA, 526 bp, Homo sapiens
  misc_feature: HIJSMM301DYUJ6.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattgggccaccttgactatcactggggcccaggtggaggatgaaggtgactacttctgtttctcaacagacaccagtgacaatcatgcgattttcggtcgggagggaccgaaacgctgaccggtcccgtgggtcgagcccaaggctgccccctccggtcactctcgttcccacccctt

SEQ ID NO: 568114 - DNA, 498 bp, Homo sapiens; identical to SEQ ID NO: 540839
  misc_feature: HIJSMM301BCJJQ.48.38.D05.1.454.light.4.raw

SEQ ID NO: 568115 - DNA, 508 bp, Homo sapiens
  misc_feature: HIJSMM301B76JX.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggcggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 568116 - DNA, 496 bp, Homo sapiens; identical to SEQ ID NO: 537925
  misc_feature: HIJSMM301AG6R5.22.14.B03.1.454.light.4.raw

SEQ ID NO: 568117 - DNA, 493 bp, Homo sapiens
  misc_feature: HIJSMM301BP4GB.48.71.G05.1.454.light.4.raw
agtatacatacacgaccggtgctcgatttagtgtcgtcgcaagagagaggggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccgccatctgatatgtatact

SEQ ID NO: 568118 - DNA, 498 bp, Homo sapiens
  misc_feature: HIJSMM301EUYCQ.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaaaacgaactagtggctgca

SEQ ID NO: 568119 - DNA, 487 bp, Homo sapiens
  misc_feature: HIJSMM301AW8Y8.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctac

SEQ ID NO: 568120 - DNA, 508 bp, Homo sapiens; identical to SEQ ID NO: 536388
  misc_feature: HIJSMM301DNXH1.11.57.F02.1.454.light.4.raw

SEQ ID NO: 568121 - DNA, 504 bp, Homo sapiens
  misc_feature: HIJSMM301BNI58.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcgactgtggttttcggtcggagggaccaacggctgaccgtcctcggtcagcccaagctgccccctcggtcactctgttcccaccct

SEQ ID NO: 568122 - DNA, 485 bp, Homo sapiens; identical to SEQ ID NO: 536695
  misc_feature: HIJSMM301A3C64.10.1.A01.1.454.light.4.raw

SEQ ID NO: 568123 - DNA, 494 bp, Homo sapiens; identical to SEQ ID NO: 534994
  misc_feature: HIJSMM301EJOBR.27.78.H01.1.454.light.4.raw

SEQ ID NO: 568124 - DNA, 445 bp, Homo sapiens; identical to SEQ ID NO: 535913
  misc_feature: HIJSMM301C33FE.5.9.A09.1.454.light.4.raw

SEQ ID NO: 568125 - DNA, 500 bp, Homo sapiens
  misc_feature: HIJSMM301DHMQX.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctaagagcctgaagattttgcagtttattactgtcagcagcgtagcatctggcctccgtacacctttggccaggggaccaagctggagatcaaacgaactgtggctgcaccatctgtcttcat

SEQ ID NO: 568126 - DNA, 498 bp, Homo sapiens
  misc_feature: HIJSMM301D5T84.7.5.A05.1.454.light.4.raw
  modified_base (429)..(429): a, c, t, g, unknown or other
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcancagcactcaggttttcggcggagggaccaagctgaccgtcctaggtcagcccaaggctgccccctcggt

SEQ ID NO: 568127 - DNA, 508 bp, Homo sapiens; identical to SEQ ID NO: 541017
  misc_feature: HIJSMM301DHNI6.17.33.C11.1.454.light.4.raw

SEQ ID NO: 568128 - DNA, 490 bp, Homo sapiens
  misc_feature: HIJSMM301B2TY8.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgtggc

SEQ ID NO: 568129 - DNA, 303 bp, Homo sapiens
  misc_feature: HIJSMM301CGMLB.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggaactgtggctgtcaccatctgtcttcatcttcccgccatctgatagtacgtga

SEQ ID NO: 568130 - DNA, 493 bp, Homo sapiens
  misc_feature: HIJSMM301BJMMB.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggtagggaccgaacggtggagatcaaacgaacttc

SEQ ID NO: 568131 - DNA, 484 bp, Homo sapiens; identical to SEQ ID NO: 556842
  misc_feature: HIJSMM301DK7QJ.26.70.G04.1.454.light.4.raw

SEQ ID NO: 568132 - DNA, 515 bp, Homo sapiens; identical to SEQ ID NO: 549865
  misc_feature: HIJSMM301AYDFX.16.66.F11.1.454.light.4.raw

SEQ ID NO: 568133 - DNA, 460 bp, Homo sapiens; identical to SEQ ID NO: 537107
  misc_feature: HIJSMM301CL4SW.22.28.C06.1.454.light.4.raw

SEQ ID NO: 568134 - DNA, 447 bp, Homo sapiens
  misc_feature: HIJSMM301EAE3F.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcatcgtcctaagtcagcccaaggccaacccctctgtcactctgttcccaccctcctccatactcgta

SEQ ID NO: 568135 - DNA, 503 bp, Homo sapiens
  misc_feature: HIJSMM301B4BII.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggcctgggaccaaagtggataccaatcgaactgtggctgcaccatctgtt

SEQ ID NO: 568136 - DNA, 484 bp, Homo sapiens
  misc_feature: HIJSMM301A30VI.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaact

SEQ ID NO: 568137 - DNA, 520 bp, Homo sapiens
  misc_feature: HIJSMM301BDEZJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaagggacgaacggtaggaagtacgaaacgaactagtggcgtgcgaccactactgtcttctacttcttcccgtccctact

SEQ ID NO: 568138 - DNA, 521 bp, Homo sapiens; identical to SEQ ID NO: 538715
  misc_feature: HIJSMM301BIWZW.27.23.C01.1.454.light.4.raw

SEQ ID NO: 568139 - DNA, 484 bp, Homo sapiens; identical to SEQ ID NO: 535400
  misc_feature: HIJSMM301BTKZS.46.26.C04.1.454.light.4.raw

SEQ ID NO: 568140 - DNA, 507 bp, Homo sapiens
  misc_feature: HIJSMM301BL9A0.10.27.C05.1.454.light.4.raw
catagtagtgcacgaccggtgctcgatttagacgcgatcgaagggtttggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 568141 - DNA, 501 bp, Homo sapiens; identical to SEQ ID NO: 535746
  misc_feature: HIJSMM301D1P13.18.11.A11.1.454.light.4.raw

SEQ ID NO: 568142 - DNA, 505 bp, Homo sapiens
  misc_feature: HIJSMM301CVWJC.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaacggctgccccctccggtcgactctgttccccg

SEQ ID NO: 568143 - DNA, 521 bp, Homo sapiens; identical to SEQ ID NO: 539470
  misc_feature: HIJSMM301BMEXS.27.23.C01.1.454.light.4.raw

SEQ ID NO: 568144 - DNA, 492 bp, Homo sapiens
  misc_feature: HIJSMM301ATW66.43.33.C11.1.454.light.4.raw
tgtgagtagtcacgaccggtgctcgatttagagtgagctcgttgggtttgggcacgaccgtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttac

SEQ ID NO: 568145 - DNA, 485 bp, Homo sapiens
  misc_feature: HIJSMM301CBZZE.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgctaacttattactgccagcagtataatgattaccctatcaccttcggccggggacacggctggaaactaaacgaactgtggctgcacc

SEQ ID NO: 568146 - DNA, 494 bp, Homo sapiens; identical to SEQ ID NO: 534992
  misc_feature: HIJSMM301EB8J5.9.1.A01.1.454.light.4.raw

SEQ ID NO: 568147 - DNA, 484 bp, Homo sapiens; identical to SEQ ID NO: 536162
  misc_feature: HIJSMM301CQCPG.13.59.F04.1.454.light.4.raw

SEQ ID NO: 568148 - DNA, 465 bp, Homo sapiens; identical to SEQ ID NO: 541152
  misc_feature: HIJSMM301ATEJ1.43.71.G05.1.454.light.4.raw

SEQ ID NO: 568149 - DNA, 489 bp, Homo sapiens; identical to SEQ ID NO: 536663
  misc_feature: HIJSMM301AO2A3.16.72.G06.1.454.light.4.raw

SEQ ID NO: 568150 - DNA, 502 bp, Homo sapiens
  misc_feature: HIJSMM301CMNAJ.19.57.F02.1.454.light.4.raw
  modified_base (417)..(417): a, c, t, g, unknown or other
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtcggggtcccctcaaggttcagcggcagtggatcgtgggacagatttcactctcgccatcagcagcctgcagactgaagtattttgctaactttattttgtcaacnggctaactacctttccccctctacgtttcggcgggggaccgaaggtggagatcaagcgaactgtggctgcaccatctgtcttcta

SEQ ID NO: 568151 - DNA, 494 bp, Homo sapiens
  misc_feature: HIJSMM301CXOA7.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagagtcaatcgaactgtggc

SEQ ID NO: 568152 - DNA, 382 bp, Homo sapiens; identical to SEQ ID NO: 558348
  misc_feature: HIJSMM301AGRHO.48.26.C04.1.454.light.4.raw

SEQ ID NO: 568153 - DNA, 496 bp, Homo sapiens
  misc_feature: HIJSMM301BT309.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgtactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 568154 - DNA, 498 bp, Homo sapiens
  misc_feature: HIJSMM301ADDGD.16.78.H01.1.454.light.4.raw
tgtactactccacgaccggtgctcgatttagtgtgagtagtttgggtttgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 568155 - DNA, 515 bp, Homo sapiens
  misc_feature: HIJSMM301B6OX3.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctccctacg

SEQ ID NO: 568156 - DNA, 514 bp, Homo sapiens
  misc_feature: HIJSMM301D16HS.17.62.F07.1.454.light.4.raw
  modified_base (494)..(494): a, c, t, g, unknown or other
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgttcgggtgttcggcggagggaccaagctgaccgtcctaggtcagcccaaggctgccccctcggtcactctgttcccnccgtcccctacgtcctaacg

SEQ ID NO: 568157 - DNA, 486 bp, Homo sapiens; identical to SEQ ID NO: 535043
  misc_feature: HIJSMM301DNVB3.46.35.D02.1.454.light.4.raw

SEQ ID NO: 568158 - DNA, 495 bp, Homo sapiens
  misc_feature: HIJSMM301CGR1R.51.69.G03.1.454.light.4.raw
cgatcgtatacacgaccggtgctcgatttagtcgctgcgtaaaggagaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcggcggagggaccaagggtgaccgtcct

SEQ ID NO: 568159 - DNA, 516 bp, Homo sapiens
  misc_feature: HIJSMM301ER3LJ.49.11.A11.1.454.light.4.raw
agtcgagagacacgaccggtgctcgatttagctacgactgcaggggtgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgta

SEQ ID NO: 568160 - DNA, 509 bp, Homo sapiens; identical to SEQ ID NO: 541417
  misc_feature: HIJSMM301B521F.16.46.E02.1.454.light.4.raw

SEQ ID NO: 568161 - DNA, 514 bp, Homo sapiens
  misc_feature: HIJSMM301CTMCC.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 568162 - DNA, 488 bp, Homo sapiens
  misc_feature: HIJSMM301C084F.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacatacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagatcaacgaa

SEQ ID NO: 568163 - DNA, 500 bp, Homo sapiens; identical to SEQ ID NO: 563448
  misc_feature: HIJSMM301C703S.22.27.C05.1.454.light.4.raw

SEQ ID NO: 568164 - DNA, 495 bp, Homo sapiens; identical to SEQ ID NO: 543094
  misc_feature: HIJSMM301D8I2R.22.57.F02.1.454.light.4.raw

SEQ ID NO: 568165 - DNA, 506 bp, Homo sapiens
  misc_feature: HIJSMM301C77GV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtaggaaatacaaacgaactagtggctgcaccatctgtcttcatccttccccg

SEQ ID NO: 568166 - DNA, 489 bp, Homo sapiens; identical to SEQ ID NO: 544582
  misc_feature: HIJSMM301BVWNS.22.65.F10.1.454.light.4.raw

SEQ ID NO: 568167 - DNA, 497 bp, Homo sapiens
  misc_feature: HIJSMM301CQJ2L.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccg

SEQ ID NO: 568168 - DNA, 511 bp, Homo sapiens
  misc_feature: HIJSMM301CSTAG.19.59.F04.1.454.light.4.raw
tactctcgtgcacgaccggtgctcgatttagtacacacacttagggattgggggcagaaggcaggactcggggcaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 568169 - DNA, 508 bp, Homo sapiens
  misc_feature: HIJSMM301DLCND.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcgaccaaggtgaccgtcctaggtcagcccaaggctgccccctcggtcacc

SEQ ID NO: 568170 - DNA, 521 bp, Homo sapiens; identical to SEQ ID NO: 539470
  misc_feature: HIJSMM301CR4LL.27.23.C01.1.454.light.4.raw

SEQ ID NO: 568171 - DNA, 515 bp, Homo sapiens
  misc_feature: HIJSMM301C96P9.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaaggctggccgtcctaggtcagcccaaggctgccccctcggtcactctgttcccaccctcctcgagtagtaca

SEQ ID NO: 568172 - DNA, 488 bp, Homo sapiens
  misc_feature: HIJSMM301DD0EQ.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgtcccccg

SEQ ID NO: 568173 - DNA, 489 bp, Homo sapiens; identical to SEQ ID NO: 535139
  misc_feature: HIJSMM301AIEF8.14.55.E11.1.454.light.4.raw

SEQ ID NO: 568174 - DNA, 472 bp, Homo sapiens; identical to SEQ ID NO: 541249
  misc_feature: HIJSMM301BY5A7.5.28.C06.1.454.light.4.raw

SEQ ID NO: 568175 - DNA, 511 bp, Homo sapiens
  misc_feature: HIJSMM301DG6ZG.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctcccgtgtctgat

SEQ ID NO: 568176 - DNA, 484 bp, Homo sapiens; identical to SEQ ID NO: 535400
  misc_feature: HIJSMM301DD5QS.46.26.C04.1.454.light.4.raw

SEQ ID NO: 568177 - DNA, 508 bp, Homo sapiens; identical to SEQ ID NO: 536062
  misc_feature: HIJSMM301DI6S8.11.57.F02.1.454.light.4.raw

SEQ ID NO: 568178 - DNA, 489 bp, Homo sapiens; identical to SEQ ID NO: 535091
  misc_feature: HIJSMM301EAOP6.47.36.D03.1.454.light.4.raw

SEQ ID NO: 568179 - DNA, 486 bp, Homo sapiens; identical to SEQ ID NO: 535385
  misc_feature: HIJSMM301DMUOV.19.71.G05.1.454.light.4.raw

SEQ ID NO: 568180 - DNA, 505 bp, Homo sapiens
  misc_feature: HIJSMM301CHSDG.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaaggtggaggtcaaacgaactgtggctgcacactctgtcttct

SEQ ID NO: 568181 - DNA, 492 bp, Homo sapiens
  misc_feature: HIJSMM301AJHQM.4.52.E08.1.454.light.4.raw
agcactgtagcacgaccggtgctcgatttagtcgagctctcagagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgctagtttattactgtcagcagcgtagcaactggcctctgctcactttcggcggaggaccgaaggtggagatacaacgaactgt

SEQ ID NO: 568182 - DNA, 503 bp, Homo sapiens
  misc_feature: HIJSMM301DCBAW.49.28.C06.1.454.light.4.raw
agtcgagagacacgaccggtgctcgatttagagctcacgtattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccactctgtctcattccc

SEQ ID NO: 568183 - DNA, 505 bp, Homo sapiens; identical to SEQ ID NO: 535503
  misc_feature: HIJSMM301D73ZZ.8.28.C06.1.454.light.4.raw

SEQ ID NO: 568184 - DNA, 482 bp, Homo sapiens; identical to SEQ ID NO: 535216
  misc_feature: HIJSMM301D60VZ.17.26.C04.1.454.light.4.raw

SEQ ID NO: 568185 - DNA, 519 bp, Homo sapiens; identical to SEQ ID NO: 565099
  misc_feature: HIJSMM301CJQ0L.53.65.F10.1.454.light.4.raw

SEQ ID NO: 568186 - DNA, 503 bp, Homo sapiens
  misc_feature: HIJSMM301C688A.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagcccaaggctgccccctggt

SEQ ID NO: 568187 - DNA, 497 bp, Homo sapiens
  misc_feature: HIJSMM301CZP4O.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatt

SEQ ID NO: 568188 - DNA, 512 bp, Homo sapiens
  misc_feature: HIJSMM301AZCEM.22.21.B10.1.454.light.4.raw
  modified_base (446)..(446): a, c, t, g, unknown or other
acatacgcgtcacgaccggtgctcgatttagtgtcgtcgcaaggggggggtcgtcaggaggcagcgctctcaggacgtcaccaccatggcctgggctctgctcctcctcagcctcctcactcgagggcacgagggtcctgggcccagtctcgccctgactcagcctccctccgcgtccgggtctcctggacagtcagtcaccatctcctgcactggaaccagcagtgacgttggtggttacaagtatgtctcctggtaccaacaccacccaggcacacgcccccaaactcatgatttatgaggtcactaagcgggcctcaggggtccctgatcgcttctctggctccaagtctggcacacggcctccctgaccgtctctgggctccaggctgaggatggaggctgattattactgctactcatatgcaggcggcaactcttgggtnttcgggcggtagggaccaaggctggaccgtctaggtcagcccaaggctcgcccctggtcactctcg

SEQ ID NO: 568189 - DNA, 513 bp, Homo sapiens
  misc_feature: HIJSMM301BOSOM.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagcccaagg

SEQ ID NO: 568190 - DNA, 487 bp, Homo sapiens; identical to SEQ ID NO: 536206
  misc_feature: HIJSMM301EQXCD.47.38.D05.1.454.light.4.raw

SEQ ID NO: 568191 - DNA, 501 bp, Homo sapiens
  misc_feature: HIJSMM301CWQNW.10.28.C06.1.454.light.4.raw
catagtagtgcacgaccggtgctcgatttagagctcacgtattgggtttggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcgggggaccgacgactgaccgtcctaggtcagcccaaggctgccccctcggtcactctcgttcccaccctcctccactactatg

SEQ ID NO: 568192 - DNA, 500 bp, Homo sapiens; identical to SEQ ID NO: 543863
  misc_feature: HIJSMM301D5LH7.12.26.C04.1.454.light.4.raw

SEQ ID NO: 568193 - DNA, 460 bp, Homo sapiens; identical to SEQ ID NO: 536053
  misc_feature: HIJSMM301D1F0V.22.28.C06.1.454.light.4.raw

SEQ ID NO: 568194 - DNA, 490 bp, Homo sapiens
  misc_feature: HIJSMM301COY8Y.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaagtccctaagctcctgatctatgttgcatccactttgcaaagtggggtcccatcaaggttcagcggcagtggatctgggacagaattcactctcacaatcagcagcctgcagcctgaagattttgctaacttattactgtcaacagcttaatagttacccgctcagtttcggcggagggaccaaggtggagatcaaacgaactgtggctgcaccatctgtt

SEQ ID NO: 568195 - DNA, 504 bp, Homo sapiens
  misc_feature: HIJSMM301C8WVM.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgactgtggctgcaccatctgtcttcatcttcccgcc

SEQ ID NO: 568196 - DNA, 478 bp, Homo sapiens; identical to SEQ ID NO: 535129
  misc_feature: HIJSMM301CJSTH.11.11.A11.1.454.light.4.raw

SEQ ID NO: 568197 - DNA, 484 bp, Homo sapiens; identical to SEQ ID NO: 535400
  misc_feature: HIJSMM301ER0DU.46.26.C04.1.454.light.4.raw

SEQ ID NO: 568198 - DNA, 496 bp, Homo sapiens; identical to SEQ ID NO: 537925
  misc_feature: HIJSMM301AZHQ6.22.14.B03.1.454.light.4.raw

SEQ ID NO: 568199 - DNA, 484 bp, Homo sapiens; identical to SEQ ID NO: 535400
  misc_feature: HIJSMM301DZR56.46.26.C04.1.454.light.4.raw

SEQ ID NO: 568200 - DNA, 493 bp, Homo sapiens
  misc_feature: HIJSMM301BRPNJ.27.78.H01.1.454.light.4.raw
  modified_base (400)..(400): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcaccttcggccaagggacacgactggagattaaacgaactgtggctgcaccatctgt

SEQ ID NO: 568201 - DNA, 479 bp, Homo sapiens; identical to SEQ ID NO: 538892
  misc_feature: HIJSMM301B9RBL.22.59.F04.1.454.light.4.raw

SEQ ID NO: 568202 - DNA, 507 bp, Homo sapiens; identical to SEQ ID NO: 538702
  misc_feature: HIJSMM301AGN7C.11.57.F02.1.454.light.4.raw

SEQ ID NO: 568203 - DNA, 488 bp, Homo sapiens; identical to SEQ ID NO: 540827
  misc_feature: HIJSMM301ANHMO.15.49.E05.1.454.light.4.raw

SEQ ID NO: 568204 - DNA, 486 bp, Homo sapiens
  misc_feature: HIJSMM301APTRH.49.79.H02.1.454.light.4.raw
agtcgagagacacgaccggtgctcgatttagtgtcacacgaagggaaaggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggaggatcaaacgaactgtggctgcacc

SEQ ID NO: 568205 - DNA, 463 bp, Homo sapiens; identical to SEQ ID NO: 535062
  misc_feature: HIJSMM301AWQNK.11.73.G07.1.454.light.4.raw

SEQ ID NO: 568206 - DNA, 444 bp, Homo sapiens; identical to SEQ ID NO: 535594
  misc_feature: HIJSMM301BN2QA.9.9.A09.1.454.light.4.raw

SEQ ID NO: 568207 - DNA, 484 bp, Homo sapiens
  misc_feature: HIJSMM301B2BN3.43.4.A04.1.454.light.4.raw
tgtgagtagtcacgaccggtgctcgatttagagtagtgatcaggggagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaaacgaactgtggctgcacc

SEQ ID NO: 568208 - DNA, 485 bp, Homo sapiens; identical to SEQ ID NO: 536040
  misc_feature: HIJSMM301CS540.15.1.A01.1.454.light.4.raw

SEQ ID NO: 568209 - DNA, 516 bp, Homo sapiens
  misc_feature: HIJSMM301ATVKA.14.78.H01.1.454.light.4.raw
cgtctagtaccacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgtctatttcggcggagggaccaagttgaccgtcctaagtcagcccaaggctcgccccctcggtcactctgtt

SEQ ID NO: 568210 - DNA, 497 bp, Homo sapiens; identical to SEQ ID NO: 538382
  misc_feature: HIJSMM301C0Q1P.3.33.C11.1.454.light.4.raw

SEQ ID NO: 568211 - DNA, 474 bp, Homo sapiens
  misc_feature: HIJSMM301BKV7D.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggtaccaaggtggacgatcaaacgaa

SEQ ID NO: 568212 - DNA, 500 bp, Homo sapiens; identical to SEQ ID NO: 542271
  misc_feature: HIJSMM301EO11B.19.78.H01.1.454.light.4.raw

SEQ ID NO: 568213 - DNA, 495 bp, Homo sapiens; identical to SEQ ID NO: 535486
  misc_feature: HIJSMM301BP6XE.26.72.G06.1.454.light.4.raw

SEQ ID NO: 568214 - DNA, 478 bp, Homo sapiens
  misc_feature: HIJSMM301ARBYF.51.77.G11.1.454.light.4.raw
cgatcgtatacacgaccggtgctcgatttagctagtcactcaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaagg

SEQ ID NO: 568215 - DNA, 522 bp, Homo sapiens
  misc_feature: HIJSMM301C342N.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccgccct

SEQ ID NO: 568216 - DNA, 488 bp, Homo sapiens
  misc_feature: HIJSMM301D8E5H.51.62.F07.1.454.light.4.raw
cgatcgtatacacgaccggtgctcgatttagtagtcgcataaagggaaagggggcaggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccacgtcactttcggcggagggaccaaggtggacctcaaacgaactgtggctgcacc

SEQ ID NO: 568217 - DNA, 501 bp, Homo sapiens
  misc_feature: HIJSMM301CR3H7.13.39.D06.1.454.light.4.raw
  modified_base (491)..(491): a, c, t, g, unknown or other
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcatattatagtactcctccacggcgtcacttcgtcggacgggacggaacggtagggaagagtanaacgaaacgt

SEQ ID NO: 568218 - DNA, 447 bp, Homo sapiens; identical to SEQ ID NO: 535201
  misc_feature: HIJSMM301CWEAV.18.9.A09.1.454.light.4.raw

SEQ ID NO: 568219 - DNA, 479 bp, Homo sapiens; identical to SEQ ID NO: 537163
  misc_feature: HIJSMM301CKQUL.13.73.G07.1.454.light.4.raw

SEQ ID NO: 568220 - DNA, 510 bp, Homo sapiens
  misc_feature: HIJSMM301BGNN6.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccttcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccg

SEQ ID NO: 568221 - DNA, 507 bp, Homo sapiens; identical to SEQ ID NO: 559118
  misc_feature: HIJSMM301D2JW5.17.87.H10.1.454.light.4.raw

SEQ ID NO: 568222 - DNA, 509 bp, Homo sapiens
  misc_feature: HIJSMM301BN3HY.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaatcaaacgaactgtggctgcaccatctgtctt

SEQ ID NO: 568223 - DNA, 501 bp, Homo sapiens; identical to SEQ ID NO: 540528
  misc_feature: HIJSMM301B2KGQ.11.31.C09.1.454.light.4.raw

SEQ ID NO: 568224 - DNA, 500 bp, Homo sapiens; identical to SEQ ID NO: 539563
  misc_feature: HIJSMM301DNUDE.8.2.A02.1.454.light.4.raw

SEQ ID NO: 568225 - DNA, 446 bp, Homo sapiens; identical to SEQ ID NO: 538346
  misc_feature: HIJSMM301EAMCC.18.9.A09.1.454.light.4.raw

SEQ ID NO: 568226 - DNA, 490 bp, Homo sapiens
  misc_feature: HIJSMM301EO5YU.52.41.D08.1.454.light.4.raw
cgcagtacgacacgaccggtgctcgatttagtcacgcgagaaagggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccaggggaccaagctggagatcaaacgaactgtggctgcacc

SEQ ID NO: 568227 - DNA, 493 bp, Homo sapiens; identical to SEQ ID NO: 536769
  misc_feature: HIJSMM301E0JY2.19.83.H06.1.454.light.4.raw

SEQ ID NO: 568228 - DNA, 512 bp, Homo sapiens
  misc_feature: HIJSMM301B3MOV.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctcgccccctcgg

SEQ ID NO: 568229 - DNA, 499 bp, Homo sapiens
  misc_feature: HIJSMM301BFE8S.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagccctgcagtctgaggaccttggagtttattactgtcagcagtatcataactggcctccgtggacgttcggccgaaggaccaaggtggacctcgaaacgaactgtggctgcaccat

SEQ ID NO: 568230 - DNA, 478 bp, Homo sapiens; identical to SEQ ID NO: 563839
  misc_feature: HIJSMM301D96RZ.13.11.A11.1.454.light.4.raw

SEQ ID NO: 568231 - DNA, 488 bp, Homo sapiens; identical to SEQ ID NO: 535862
  misc_feature: HIJSMM301ER4JH.7.75.G09.1.454.light.4.raw

SEQ ID NO: 568232 - DNA, 486 bp, Homo sapiens; identical to SEQ ID NO: 535290
  misc_feature: HIJSMM301ANQZQ.3.12.B01.1.454.light.4.raw

SEQ ID NO: 568233 - DNA, 444 bp, Homo sapiens; identical to SEQ ID NO: 534993
  misc_feature: HIJSMM301AYBWC.5.9.A09.1.454.light.4.raw

SEQ ID NO: 568234 - DNA, 517 bp, Homo sapiens
  misc_feature: HIJSMM301EDX9X.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccgaagtggcaatcaaccgaactgtggctgcaccatctgtcttcatcttccccg

SEQ ID NO: 568235 - DNA, 519 bp, Homo sapiens; identical to SEQ ID NO: 544155
  misc_feature: HIJSMM301DHGJC.19.80.H03.1.454.light.4.raw

SEQ ID NO: 568236 - DNA, 495 bp, Homo sapiens; identical to SEQ ID NO: 535007
  misc_feature: HIJSMM301BISIH.22.5.A05.1.454.light.4.raw

SEQ ID NO: 568237 - DNA, 489 bp, Homo sapiens
  misc_feature: HIJSMM301AJHSX.49.37.D04.1.454.light.4.raw
agtcgagagacacgaccggtgctcgatttagtagcatactgttgggtttggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactagtggctgcaccatctgtt

SEQ ID NO: 568238 - DNA, 515 bp, Homo sapiens
  misc_feature: HIJSMM301BYWVH.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcgggaccagaccctggagcctcagttggaagcagccgatccagcctgcggagcctgtggggcaggtcagcccaaggctgccccctcggtcactctgttcccgccctcctccacg

SEQ ID NO: 568239 - DNA, 489 bp, Homo sapiens
  misc_feature: HIJSMM301ELAQ5.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatacaaacgaa

SEQ ID NO: 568240 - DNA, 521 bp, Homo sapiens; identical to SEQ ID NO: 539470
  misc_feature: HIJSMM301DZH6G.27.23.C01.1.454.light.4.raw

SEQ ID NO: 568241 - DNA, 491 bp, Homo sapiens; identical to SEQ ID NO: 535194
  misc_feature: HIJSMM301ALDZM.26.78.H01.1.454.light.4.raw

SEQ ID NO: 568242 - DNA, 491 bp, Homo sapiens; identical to SEQ ID NO: 536211
  misc_feature: HIJSMM301BDWR3.16.53.E09.1.454.light.4.raw

SEQ ID NO: 568243 - DNA, 499 bp, Homo sapiens
  misc_feature: HIJSMM301BUOBL.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggtttcggcgggggaccaagttgaccgtcgtgggtcagcccaaggctgccccctcggtcactctccg

SEQ ID NO: 568244 - DNA, 550 bp, Homo sapiens
  misc_feature: HIJSMM301BREKW.18.59.F04.1.454.light.4.raw
tacgagtatgcacgaccggtgctcgatttagtacacacacttagggattaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacgacgacactactcctaatcgttccgttaccggtaacggtaccgggaaccgtaaggtacccacccgttaccgttacggtacgaccgaacccgacggaacccccaaaccccctacg

SEQ ID NO: 568245 - DNA, 494 bp, Homo sapiens; identical to SEQ ID NO: 534992
  misc_feature: HIJSMM301CRSS4.9.1.A01.1.454.light.4.raw

SEQ ID NO: 568246 - DNA, 495 bp, Homo sapiens; identical to SEQ ID NO: 537716
  misc_feature: HIJSMM301BM1U1.22.14.B03.1.454.light.4.raw

SEQ ID NO: 568247 - DNA, 470 bp, Homo sapiens
  misc_feature: HIJSMM301A06WA.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacc

SEQ ID NO: 568248 - DNA, 510 bp, Homo sapiens
  misc_feature: HIJSMM301A7DXT.8.34.D01.1.454.light.4.raw
ctcgcgtgtccacgaccggtgctcgatttagatcgtctgtgttgggtttgggggaggaactgctcagttaggacccagagggaaccatggaagcctcagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaacgtggatatacaaacgaaacctgtggcgtgcaccatctgtctt

SEQ ID NO: 568249 - DNA, 484 bp, Homo sapiens; identical to SEQ ID NO: 537891
  misc_feature: HIJSMM301EMR3V.10.1.A01.1.454.light.4.raw

SEQ ID NO: 568250 - DNA, 504 bp, Homo sapiens
  misc_feature: HIJSMM301AM883.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaaactgaccgtcctaggtcagcccaa

SEQ ID NO: 568251 - DNA, 491 bp, Homo sapiens; identical to SEQ ID NO: 538021
  misc_feature: HIJSMM301A2BI1.3.72.G06.1.454.light.4.raw

SEQ ID NO: 568252 - DNA, 512 bp, Homo sapiens; identical to SEQ ID NO: 565140
  misc_feature: HIJSMM301A23A0.16.46.E02.1.454.light.4.raw

SEQ ID NO: 568253 - DNA, 487 bp, Homo sapiens
  misc_feature: HIJSMM301DEIML.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccaggcccctctcttgattatatataaggacactgagaggccctcagggactccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtcta

SEQ ID NO: 568254 - DNA, 500 bp, Homo sapiens; identical to SEQ ID NO: 539563
  misc_feature: HIJSMM301ESM35.8.2.A02.1.454.light.4.raw

SEQ ID NO: 568255 - DNA, 492 bp, Homo sapiens
  misc_feature: HIJSMM301CUEL7.8.81.H04.1.454.light.4.raw
ctcgcgtgtccacgaccggtgctcgatttagtagtgtagattcgcgggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccgggggaccaagctggagatcaaacgaactgtggctgcaccatctgtcttca

SEQ ID NO: 568256 - DNA, 487 bp, Homo sapiens
  misc_feature: HIJSMM301DB24G.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgcccctcggtcact

SEQ ID NO: 568257 - DNA, 493 bp, Homo sapiens; identical to SEQ ID NO: 535657
  misc_feature: HIJSMM301CSHG6.27.78.H01.1.454.light.4.raw

SEQ ID NO: 568258 - DNA, 440 bp, Homo sapiens
  misc_feature: HIJSMM301BUFFO.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaaactggatgtggtattcggcggagggacccacgtaaccgtcctaggtcagcccaaggctgccccctcggtcactctgttcccaccctcctcgtatctcg

SEQ ID NO: 568259 - DNA, 488 bp, Homo sapiens
  misc_feature: HIJSMM301BGZ0M.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaagggaccaaggtggaaatacaaacgaactagtggctgcaccat

SEQ ID NO: 568260 - DNA, 454 bp, Homo sapiens; identical to SEQ ID NO: 534964
  misc_feature: HIJSMM301CQPVB.19.86.H09.1.454.light.4.raw

SEQ ID NO: 568261 - DNA, 489 bp, Homo sapiens; identical to SEQ ID NO: 535139
  misc_feature: HIJSMM301AEIRX.14.55.E11.1.454.light.4.raw

SEQ ID NO: 568262 - DNA, 513 bp, Homo sapiens
  misc_feature: HIJSMM301DW85A.7.34.D01.1.454.light.4.raw
cgtgtctctacacgaccggtgctcgatttagatcgtctgtgttgggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcgggcggagggaccaagctgaccgtcctgcgtcagcccaaggctgccccctcggtcact

SEQ ID NO: 568263 - DNA, 501 bp, Homo sapiens
  misc_feature: HIJSMM301BESHY.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggccaacccca

SEQ ID NO: 568264 - DNA, 506 bp, Homo sapiens
  misc_feature: HIJSMM301CM3UD.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 568265 - DNA, 486 bp, Homo sapiens; identical to SEQ ID NO: 535043
  misc_feature: HIJSMM301C1FQO.46.35.D02.1.454.light.4.raw

SEQ ID NO: 568266 - DNA, 482 bp, Homo sapiens; identical to SEQ ID NO: 535920
  misc_feature: HIJSMM301B6VVC.19.71.G05.1.454.light.4.raw

SEQ ID NO: 568267 - DNA, 505 bp, Homo sapiens; identical to SEQ ID NO: 547383
  misc_feature: HIJSMM301B90FQ.3.79.H02.1.454.light.4.raw

SEQ ID NO: 568268 - DNA, 501 bp, Homo sapiens
  misc_feature: HIJSMM301CHP9R.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcta

SEQ ID NO: 568269 - DNA, 448 bp, Homo sapiens; identical to SEQ ID NO: 544682
  misc_feature: HIJSMM301CIPLI.18.9.A09.1.454.light.4.raw

SEQ ID NO: 568270 - DNA, 492 bp, Homo sapiens
  misc_feature: HIJSMM301C5162.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacagggtcccatcaaggttcagtggaggtggatctgggacagattttactctcggcatccgcagcctgcagcctgaagattttgcgacatattactgtcaacagtatgaaaatgtccgctcactttcgcgggggaccgaaggtaggagttcaacgaaactgtggctgcaccaactctgtcttc

SEQ ID NO: 568271 - DNA, 502 bp, Homo sapiens; identical to SEQ ID NO: 543695
  misc_feature: HIJSMM301D397I.19.78.H01.1.454.light.4.raw

SEQ ID NO: 568272 - DNA, 497 bp, Homo sapiens
  misc_feature: HIJSMM301CXHCA.52.54.E10.1.454.light.4.raw
cgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcccccagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagtccaaggccaaccccactgtcta

SEQ ID NO: 568273 - DNA, 509 bp, Homo sapiens; identical to SEQ ID NO: 536348
  misc_feature: HIJSMM301EOALR.43.67.G01.1.454.light.4.raw

SEQ ID NO: 568274 - DNA, 496 bp, Homo sapiens
  misc_feature: HIJSMM301DSI6T.9.1.A01.1.454.light.4.raw
tgatacgtctcacgaccggtgctcgatttagacgtctcatcagggggagctgctcagttaggacccagagggaaccatggaaacccagcgcagcttctcttcctcctgctactctggctcccagataccaccggagaaattgtgttgacgcagtctccgggcaccctgtctttctctccaggggagacgagccaccctctcctgcaggaccagtcagagtgttaccagcaactacttggcctggtaccagcagaaatctggccagcctcccaggcctcctcatctatggtgaatccaacagggccactggcatcccagacaggttcagtggcagtgggtctgggacagacttcactctcaccatcagcagactggagcctgaggattttgcagtgtattactgttcagcagtatcataggtcaaacaccttcggccaagggacacgactggagattaaaggaactgtggctgcaccatctgtcttcatcttccccg

SEQ ID NO: 568275 - DNA, 484 bp, Homo sapiens; identical to SEQ ID NO: 535240
  misc_feature: HIJSMM301AIJW6.47.60.F05.1.454.light.4.raw

SEQ ID NO: 568276 - DNA, 483 bp, Homo sapiens; identical to SEQ ID NO: 536836
  misc_feature: HIJSMM301A6UZR.3.38.D05.1.454.light.4.raw

SEQ ID NO: 568277 - DNA, 501 bp, Homo sapiens; identical to SEQ ID NO: 535746
  misc_feature: HIJSMM301BEMMU.18.11.A11.1.454.light.4.raw

SEQ ID NO: 568278 - DNA, 473 bp, Homo sapiens
  misc_feature: HIJSMM301EPK0B.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccactcgtctacgtgcggcggtgtcggacgacggcac

SEQ ID NO: 568279 - DNA, 492 bp, Homo sapiens
  misc_feature: HIJSMM301AXD53.52.58.F03.1.454.light.4.raw
cgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacagacttcactctcaccatcagcggtcttcaacctgaggactttggaacttactactgtcagcagagtgataatacccctcagactttcggccctgggactacagtggatgtcaaacgaacctagtggctgcaccactcttcg

SEQ ID NO: 568280 - DNA, 500 bp, Homo sapiens
  misc_feature: HIJSMM301DTOMA.48.41.D08.1.454.light.4.raw
agtatacatacacgaccggtgctcgatttagtcacgcgagaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 568281 - DNA, 496 bp, Homo sapiens; identical to SEQ ID NO: 552908
  misc_feature: HIJSMM301D0IR4.19.10.A10.1.454.light.4.raw

SEQ ID NO: 568282 - DNA, 504 bp, Homo sapiens; identical to SEQ ID NO: 535128
  misc_feature: HIJSMM301DNGZU.19.85.H08.1.454.light.4.raw

SEQ ID NO: 568283 - DNA, 504 bp, Homo sapiens
  misc_feature: HIJSMM301AWZZN.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccccactgtcactctgttcccaccctcctcta

SEQ ID NO: 568284 - DNA, 484 bp, Homo sapiens
  misc_feature: HIJSMM301A4DMU.40.77.G11.1.454.light.4.raw
tctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagaattcgctctcaccatcagcagcctgcagcctgatgattttgcaacttattactgccaacactatgatagttattctccgtacacctttggccagggaccaaggtggagatcaagcgaactgtggctgcacc

SEQ ID NO: 568285 - DNA, 494 bp, Homo sapiens
  misc_feature: HIJSMM301BD22U.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactagtggctgcaccatctgtctt

SEQ ID NO: 568286 - DNA, 490 bp, Homo sapiens; identical to SEQ ID NO: 535064
  misc_feature: HIJSMM301EN886.10.72.G06.1.454.light.4.raw

SEQ ID NO: 568287 - DNA, 494 bp, Homo sapiens; identical to SEQ ID NO: 537501
  misc_feature: HIJSMM301CYJ9W.10.79.H02.1.454.light.4.raw

SEQ ID NO: 568288 - DNA, 504 bp, Homo sapiens
  misc_feature: HIJSMM301BBYYL.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccat

SEQ ID NO: 568289 - DNA, 486 bp, Homo sapiens; identical to SEQ ID NO: 537238
  misc_feature: HIJSMM301EUG1Q.19.71.G05.1.454.light.4.raw

SEQ ID NO: 568290 - DNA, 508 bp, Homo sapiens; identical to SEQ ID NO: 543419
  misc_feature: HIJSMM301DL5SD.4.10.A10.1.454.light.4.raw

SEQ ID NO: 568291 - DNA, 485 bp, Homo sapiens
  misc_feature: HIJSMM301ET5V3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 568292 - DNA, 499 bp, Homo sapiens
  misc_feature: HIJSMM301B6YUX.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcact

SEQ ID NO: 568293 - DNA, 454 bp, Homo sapiens; identical to SEQ ID NO: 534964
  misc_feature: HIJSMM301AYJHO.19.86.H09.1.454.light.4.raw

SEQ ID NO: 568294 - DNA, 485 bp, Homo sapiens
  misc_feature: HIJSMM301BHBJB.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaagtggatatcaaacgaactagtggctgcaccatctgtt

SEQ ID NO: 568295 - DNA, 489 bp, Homo sapiens
  misc_feature: HIJSMM301BEHN1.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttatactgcatgcaagttctacaaacttcctacacttttggccaggggaccaagctggagatcaaacgaactgtgg

SEQ ID NO: 568296 - DNA, 522 bp, Homo sapiens; identical to SEQ ID NO: 543352
  misc_feature: HIJSMM301ET8UL.27.23.C01.1.454.light.4.raw

SEQ ID NO: 568297 - DNA, 494 bp, Homo sapiens; identical to SEQ ID NO: 534992
  misc_feature: HIJSMM301AQMXY.9.1.A01.1.454.light.4.raw

SEQ ID NO: 568298 - DNA, 490 bp, Homo sapiens; identical to SEQ ID NO: 535234
  misc_feature: HIJSMM301CFW4V.17.21.B10.1.454.light.4.raw

SEQ ID NO: 568299 - DNA, 485 bp, Homo sapiens; identical to SEQ ID NO: 535985
  misc_feature: HIJSMM301D3BI7.15.1.A01.1.454.light.4.raw

SEQ ID NO: 568300 - DNA, 502 bp, Homo sapiens; identical to SEQ ID NO: 536253
  misc_feature: HIJSMM301CIXWW.21.22.B11.1.454.light.4.raw

SEQ ID NO: 568301 - DNA, 505 bp, Homo sapiens
  misc_feature: HIJSMM301D6UVN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggtcaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatacaaacgaactagtggctgcaccatctgtcttcatcttccccg

SEQ ID NO: 568302 - DNA, 499 bp, Homo sapiens; identical to SEQ ID NO: 539754
  misc_feature: HIJSMM301B11QH.11.21.B10.1.454.light.4.raw

SEQ ID NO: 568303 - DNA, 482 bp, Homo sapiens; identical to SEQ ID NO: 538815
  misc_feature: HIJSMM301BHK6H.4.34.D01.1.454.light.4.raw

SEQ ID NO: 568304 - DNA, 496 bp, Homo sapiens
  misc_feature: HIJSMM301AY3CF.40.17.B06.1.454.light.4.raw
tctagcgactcacgaccggtgctcgatttagtcgatagtgaagggggtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaaactgtggctgcaccatctgtcttcatcttcccgcca

SEQ ID NO: 568305 - DNA, 524 bp, Homo sapiens
  misc_feature: HIJSMM301BPKBS.41.33.C11.1.454.light.4.raw
tctatactatcacgaccggtgctcgatttagagtgagctcgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctggtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgagggccggggatgaggccacctactattgtcacgtctgggagactggtgatgatcctgtggcgctattcggcggagggacgaagctgaccgtcctgggtcagcccaaggctcgccccctcggtcactctgttcccaccctcctcta

SEQ ID NO: 568306 - DNA, 444 bp, Homo sapiens; identical to SEQ ID NO: 535192
  misc_feature: HIJSMM301BLB0I.5.9.A09.1.454.light.4.raw

SEQ ID NO: 568307 - DNA, 491 bp, Homo sapiens; identical to SEQ ID NO: 538021
  misc_feature: HIJSMM301CP3AT.3.72.G06.1.454.light.4.raw

SEQ ID NO: 568308 - DNA, 496 bp, Homo sapiens
  misc_feature: HIJSMM301BI29R.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagacccggttcagtggcagtgggtctgggacagacttcactctcaccatcagcagtctgcagtctgaagattttgctagtttattactgtcagcagtataataactggcctccgtacatgtacacttttggccaggggaccaaccgtggagatcagacgaa

SEQ ID NO: 568309 - DNA, 489 bp, Homo sapiens; identical to SEQ ID NO: 535139
  misc_feature: HIJSMM301BN56C.14.55.E11.1.454.light.4.raw

SEQ ID NO: 568310 - DNA, 507 bp, Homo sapiens
  misc_feature: HIJSMM301AKCNN.47.38.D05.1.454.light.4.raw
agctcacgtacacgaccggtgctcgatttagtatctgatagttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagatttacgctgaaaatcagtaggtggaggctgaggatgttggggttattactgcatgcaagttctacaaacttcctacacttttggcctagggggacccaaggcctggaggactacaaacgaactgtaggctggctaacccg

SEQ ID NO: 568311 - DNA, 504 bp, Homo sapiens; identical to SEQ ID NO: 561241
  misc_feature: HIJSMM301BNQX3.10.71.G05.1.454.light.4.raw

SEQ ID NO: 568312 - DNA, 471 bp, Homo sapiens; identical to SEQ ID NO: 539388
  misc_feature: HIJSMM301DBQWB.13.39.D06.1.454.light.4.raw

SEQ ID NO: 568313 - DNA, 506 bp, Homo sapiens
  misc_feature: HIJSMM301AOHV5.48.48.E04.1.454.light.4.raw
agtatacatacacgaccggtgctcgatttagagagcgtcacagagagaagggcacgaccggtgctcgatttagagtgagctcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgacccg

SEQ ID NO: 568314 - DNA, 486 bp, Homo sapiens
  misc_feature: HIJSMM301A36FT.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccatcctgaggacgaggctgactattactgctcagcatgggacagcagcctcaatgtttgggtgttcggcggagggaccaagctgaccgtctaggtcacg

SEQ ID NO: 568315 - DNA, 493 bp, Homo sapiens; identical to SEQ ID NO: 535745
  misc_feature: HIJSMM301EESKA.47.78.H01.1.454.light.4.raw

SEQ ID NO: 568316 - DNA, 504 bp, Homo sapiens; identical to SEQ ID NO: 535077
  misc_feature: HIJSMM301A63WZ.8.28.C06.1.454.light.4.raw

SEQ ID NO: 568317 - DNA, 494 bp, Homo sapiens
  misc_feature: HIJSMM301DW931.52.33.C11.1.454.light.4.raw
cgcagtacgacacgaccggtgctcgatttagagtgagctcgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagagacctggccaggctcccagactcctcatctctgatgcatctacttgggccactggcgtcccagccaggttcagtggcagtgggcctgggacagtcttcactctcgtcatcagcagcctagagcctgaagactttgcgctttattactgtcagcagtgttgcaactggcatttcggcggagggaccaaggtggagatcaaacgcaggaactgtggctgcaccatctgtcttcta

SEQ ID NO: 568318 - DNA, 508 bp, Homo sapiens
  misc_feature: HIJSMM301DY19V.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccctcc

SEQ ID NO: 568319 - DNA, 384 bp, Homo sapiens; identical to SEQ ID NO: 555393
  misc_feature: HIJSMM301CRT6Z.48.87.H10.1.454.light.4.raw

SEQ ID NO: 568320 - DNA, 491 bp, Homo sapiens
  misc_feature: HIJSMM301BIAJ1.5.35.D02.1.454.light.4.raw
  modified_base (479)..(479): a, c, t, g, unknown or other
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcnccatctgtcttc

SEQ ID NO: 568321 - DNA, 512 bp, Homo sapiens
  misc_feature: HIJSMM301CIXES.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctcgttcccaccct

SEQ ID NO: 568322 - DNA, 511 bp, Homo sapiens
  misc_feature: HIJSMM301AUKWT.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctcgccccctcggtcactctgttcccaccctt

SEQ ID NO: 568323 - DNA, 484 bp, Homo sapiens; identical to SEQ ID NO: 535400
  misc_feature: HIJSMM301DO0HA.46.26.C04.1.454.light.4.raw

SEQ ID NO: 568324 - DNA, 507 bp, Homo sapiens
  misc_feature: HIJSMM301E14KX.19.72.G06.1.454.light.4.raw
tactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcact

SEQ ID NO: 568325 - DNA, 504 bp, Homo sapiens; identical to SEQ ID NO: 549963
  misc_feature: HIJSMM301D0ST8.19.78.H01.1.454.light.4.raw

SEQ ID NO: 568326 - DNA, 492 bp, Homo sapiens; identical to SEQ ID NO: 547805
  misc_feature: HIJSMM301A2L93.48.38.D05.1.454.light.4.raw

SEQ ID NO: 568327 - DNA, 441 bp, Homo sapiens; identical to SEQ ID NO: 535074
  misc_feature: HIJSMM301EGFHS.11.3.A03.1.454.light.4.raw

SEQ ID NO: 568328 - DNA, 495 bp, Homo sapiens; identical to SEQ ID NO: 545900
  misc_feature: HIJSMM301EF3BF.11.59.F04.1.454.light.4.raw

SEQ ID NO: 568329 - DNA, 499 bp, Homo sapiens; identical to SEQ ID NO: 536875
  misc_feature: HIJSMM301ARB08.51.26.C04.1.454.light.4.raw

SEQ ID NO: 568330 - DNA, 499 bp, Homo sapiens
  misc_feature: HIJSMM301E2QSP.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccttccacttcgtcggacgggacgaacggtaggaggatcaagacgaacgtacgtggtcgtgcaccact

SEQ ID NO: 568331 - DNA, 484 bp, Homo sapiens
  misc_feature: HIJSMM301B2HOD.51.60.F05.1.454.light.4.raw
cgatcgtatacacgaccggtgctcgatttagtacgtcatcagggaaaggggggccgtcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 568332 - DNA, 504 bp, Homo sapiens; identical to SEQ ID NO: 539091
  misc_feature: HIJSMM301CGWQP.8.28.C06.1.454.light.4.raw

SEQ ID NO: 568333 - DNA, 503 bp, Homo sapiens; identical to SEQ ID NO: 563037
  misc_feature: HIJSMM301EGV5D.9.12.B01.1.454.light.4.raw

SEQ ID NO: 568334 - DNA, 504 bp, Homo sapiens
  misc_feature: HIJSMM301CGSS8.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcact

SEQ ID NO: 568335 - DNA, 509 bp, Homo sapiens
  misc_feature: HIJSMM301BZHKO.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccactttcggcccgtgggaccaaggtggagatcaaacgaactgtggctgcaccatctgtcttcta

SEQ ID NO: 568336 - DNA, 520 bp, Homo sapiens; identical to SEQ ID NO: 537173
  misc_feature: HIJSMM301C1RV0.27.23.C01.1.454.light.4.raw

SEQ ID NO: 568337 - DNA, 388 bp, Homo sapiens
  misc_feature: HIJSMM301E1U5A.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctggtcactctgttcccaccctcctccgagcgacga

SEQ ID NO: 568338 - DNA, 505 bp, Homo sapiens
  misc_feature: HIJSMM301C5KSV.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaaggccaacccccactgtcta

SEQ ID NO: 568339 - DNA, 497 bp, Homo sapiens; identical to SEQ ID NO: 535740
  misc_feature: HIJSMM301B8JG5.3.71.G05.1.454.light.4.raw

SEQ ID NO: 568340 - DNA, 517 bp, Homo sapiens
  misc_feature: HIJSMM301ELZYN.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagccaaggctgccccctcggtcactctgttcccaccctcctccacta

SEQ ID NO: 568341 - DNA, 509 bp, Homo sapiens
  misc_feature: HIJSMM301AETZD.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatacagcagagtggaggctgaggatgttgggggtttatttactgcatgcaagctctacaaactccttacactttggtcgacggggaccgaacgacgtggtaggatactaaacgaaactagtggcg

SEQ ID NO: 568342 - DNA, 506 bp, Homo sapiens
  misc_feature: HIJSMM301B8VNT.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgt

SEQ ID NO: 568343 - DNA, 495 bp, Homo sapiens
  misc_feature: HIJSMM301CNMQN.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtgagatcaaacgaactgt

SEQ ID NO: 568344 - DNA, 491 bp, Homo sapiens
  misc_feature: HIJSMM301AHVFI.41.72.G06.1.454.light.4.raw
tctatactatcacgaccggtgctcgatttagctacgactgcaagggaaagggggaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaagg

SEQ ID NO: 568345 - DNA, 487 bp, Homo sapiens; identical to SEQ ID NO: 535583
  misc_feature: HIJSMM301BB0EV.22.73.G07.1.454.light.4.raw

SEQ ID NO: 568346 - DNA, 495 bp, Homo sapiens; identical to SEQ ID NO: 549777
  misc_feature: HIJSMM301EC9XO.51.35.D02.1.454.light.4.raw

SEQ ID NO: 568347 - DNA, 491 bp, Homo sapiens
  misc_feature: HIJSMM301CNSYG.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatacaaacgaactgtggctgcaccatcttcg

SEQ ID NO: 568348 - DNA, 472 bp, Homo sapiens
  misc_feature: HIJSMM301DY4JX.49.79.H02.1.454.light.4.raw
agtcgagagacacgaccggtgctcgatttagtgtcacacgaagggaaagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacagggtcccatcaaggttcagtggaagtggctctgggacagattttactttcaccatcagcaggctgcagcctgaagatattgcaacatattactgtcaacagtatgatcgtctccgctcacttcggcgggggaccaaggtggagatcaagcgaactgt

SEQ ID NO: 568349 - DNA, 502 bp, Homo sapiens
  misc_feature: HIJSMM301D6URH.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataaacactatactattcggcggagggaccaagctgaccgtcctgcgtcagcccaaggctgccccctcggtcact

SEQ ID NO: 568350 - DNA, 494 bp, Homo sapiens; identical to SEQ ID NO: 535276
  misc_feature: HIJSMM301B9WE8.16.6.A06.1.454.light.4.raw

SEQ ID NO: 568351 - DNA, 515 bp, Homo sapiens
  misc_feature: HIJSMM301DV1UW.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccacttcggcctcgggaccaaaattagagaatacaaacaacgtagtggctgcaccatctgtcttctactcttcccgt

SEQ ID NO: 568352 - DNA, 512 bp, Homo sapiens
  misc_feature: HIJSMM301EWFR5.43.5.A05.1.454.light.4.raw
  modified_base (276)..(276): a, c, t, g, unknown or other
  modified_base (498)..(498): a, c, t, g, unknown or other
tgtgagtagtcacgaccggtgctcgatttagatagatagacagggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccgganactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctggtcactctgttcccnccctcctcactact

SEQ ID NO: 568353 - DNA, 485 bp, Homo sapiens; identical to SEQ ID NO: 536075
  misc_feature: HIJSMM301BRF2F.17.21.B10.1.454.light.4.raw

SEQ ID NO: 568354 - DNA, 489 bp, Homo sapiens; identical to SEQ ID NO: 536013
  misc_feature: HIJSMM301EEMEZ.26.23.C01.1.454.light.4.raw

SEQ ID NO: 568355 - DNA, 490 bp, Homo sapiens
  misc_feature: HIJSMM301C0JAK.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacttcggcggagggaccagggtggagatcaaacgactgtggctgcaccatctgtcttcat

SEQ ID NO: 568356 - DNA, 504 bp, Homo sapiens; identical to SEQ ID NO: 549053
  misc_feature: HIJSMM301A6UY6.4.71.G05.1.454.light.4.raw

SEQ ID NO: 568357 - DNA, 502 bp, Homo sapiens; identical to SEQ ID NO: 541971
  misc_feature: HIJSMM301B0IGU.4.39.D06.1.454.light.4.raw

SEQ ID NO: 568358 - DNA, 485 bp, Homo sapiens
  misc_feature: HIJSMM301B44MD.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtctctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 568359 - DNA, 474 bp, Homo sapiens
  misc_feature: HIJSMM301ERWH8.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccgaacggtggagatcaacgaa

SEQ ID NO: 568360 - DNA, 507 bp, Homo sapiens
  misc_feature: HIJSMM301CN8N7.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccactgtcact

SEQ ID NO: 568361 - DNA, 514 bp, Homo sapiens
  misc_feature: HIJSMM301BW0GZ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggggcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 568362 - DNA, 517 bp, Homo sapiens
  misc_feature: HIJSMM301C404F.16.1.A01.1.454.light.4.raw
tgtactactccacgaccggtgctcgatttagacgtctcatcaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgacccgtctctggcctccagactgaggacgaggcctgattattactgccactcatatagaagtagtactactcctgtggttttcggcggagggaccaagctgaccgtcctaggtcagcccaaggctgccccctcggtcactctgttccccg

SEQ ID NO: 568363 - DNA, 454 bp, Homo sapiens; identical to SEQ ID NO: 535005
  misc_feature: HIJSMM301BWIBW.19.86.H09.1.454.light.4.raw

SEQ ID NO: 568364 - DNA, 498 bp, Homo sapiens
  misc_feature: HIJSMM301D1S9C.10.65.F10.1.454.light.4.raw
catagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaacccccgttactttcggcggagggaccaaggtggagatcaaacgaactgtggctgcaccatctgtcttcatcttcccgccc

SEQ ID NO: 568365 - DNA, 467 bp, Homo sapiens
  misc_feature: HIJSMM301B2J8L.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccaagggacacgactggagattaaacgaa

SEQ ID NO: 568366 - DNA, 493 bp, Homo sapiens
  misc_feature: HIJSMM301BQ8LZ.27.78.H01.1.454.light.4.raw
  modified_base (461)..(461): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcaagggacacgactgganattaaacgaactgtggctgcaccatctgtctt

SEQ ID NO: 568367 - DNA, 502 bp, Homo sapiens; identical to SEQ ID NO: 539002
  misc_feature: HIJSMM301DZ312.18.59.F04.1.454.light.4.raw

SEQ ID NO: 568368 - DNA, 488 bp, Homo sapiens
  misc_feature: HIJSMM301CN7IY.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttggttctaatcgggcctccggggtccctgacaggttcagtggcagtggatcaggcacagattttacactgaaaatcagcagagtggaggctgaggatgttggggtttattactgcatgcagctctacaaactccttacacttttggccagggaccaagctggagatcaaacgaactgt

SEQ ID NO: 568369 - DNA, 494 bp, Homo sapiens; identical to SEQ ID NO: 558889
  misc_feature: HIJSMM301AWCVG.47.78.H01.1.454.light.4.raw

SEQ ID NO: 568370 - DNA, 504 bp, Homo sapiens
  misc_feature: HIJSMM301BOK3Y.43.87.H10.1.454.light.4.raw
tgtgagtagtcacgaccggtgctcgatttagcagtactgcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagccccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgcccccc

SEQ ID NO: 568371 - DNA, 491 bp, Homo sapiens
  misc_feature: HIJSMM301A5I23.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccgagggtggagatcagacgaactgtggctgcacatctgt

SEQ ID NO: 568372 - DNA, 508 bp, Homo sapiens
  misc_feature: HIJSMM301B74JN.41.26.C04.1.454.light.4.raw
tctatactatcacgaccggtgctcgatttagtctagcgactttgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccta

SEQ ID NO: 568373 - DNA, 486 bp, Homo sapiens; identical to SEQ ID NO: 537310
  misc_feature: HIJSMM301B71SA.15.28.C06.1.454.light.4.raw

SEQ ID NO: 568374 - DNA, 504 bp, Homo sapiens
  misc_feature: HIJSMM301BW0RA.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgagggctgactattactgtgcatcacgggacgcaacatgggatggacaatctgagcggttgggtgttcggcggagggaccaaactgaccgtcctaggtcagcccaa

SEQ ID NO: 568375 - DNA, 501 bp, Homo sapiens; identical to SEQ ID NO: 537793
  misc_feature: HIJSMM301AWKGH.15.37.D04.1.454.light.4.raw

SEQ ID NO: 568376 - DNA, 493 bp, Homo sapiens; identical to SEQ ID NO: 536769
  misc_feature: HIJSMM301EUBVE.19.83.H06.1.454.light.4.raw

SEQ ID NO: 568377 - DNA, 505 bp, Homo sapiens; identical to SEQ ID NO: 536254
  misc_feature: HIJSMM301CTRCD.7.71.G05.1.454.light.4.raw

SEQ ID NO: 568378 - DNA, 494 bp, Homo sapiens
  misc_feature: HIJSMM301AEEY8.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaacgtggagatcaaacgaactgtggctgcaccatctgtctt

SEQ ID NO: 568379 - DNA, 506 bp, Homo sapiens
  misc_feature: HIJSMM301D6H9C.21.22.B11.1.454.light.4.raw
  modified_base (463)..(463): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggcctccggtccgaggatgaggctgactattactgtgcatcacgggacgcaacatgggatgacaatctgagcggttgggtnttcgggcggagggaccaaactgaccgtcctaggtcagccccaa

SEQ ID NO: 568380 - DNA, 504 bp, Homo sapiens; identical to SEQ ID NO: 563516
  misc_feature: HIJSMM301BA3QW.12.53.E09.1.454.light.4.raw

SEQ ID NO: 568381 - DNA, 479 bp, Homo sapiens
  misc_feature: HIJSMM301EDK0C.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtgctgcacc

SEQ ID NO: 568382 - DNA, 489 bp, Homo sapiens
  misc_feature: HIJSMM301AOGVV.48.54.E10.1.454.light.4.raw
agtatacatacacgaccggtgctcgatttagatcgtagcagaacacacaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttgggtgttcggcggagggaccagggtgacccg

SEQ ID NO: 568383 - DNA, 496 bp, Homo sapiens; identical to SEQ ID NO: 540132
  misc_feature: HIJSMM301CXOLS.3.71.G05.1.454.light.4.raw

SEQ ID NO: 568384 - DNA, 485 bp, Homo sapiens; identical to SEQ ID NO: 536630
  misc_feature: HIJSMM301BFGFN.13.56.F01.1.454.light.4.raw

SEQ ID NO: 568385 - DNA, 509 bp, Homo sapiens; identical to SEQ ID NO: 541829
  misc_feature: HIJSMM301AZQ9I.17.28.C06.1.454.light.4.raw

SEQ ID NO: 568386 - DNA, 505 bp, Homo sapiens
  misc_feature: HIJSMM301BNEXZ.52.34.D01.1.454.light.4.raw
cgcagtacgacacgaccggtgctcgatttagatcgtctgtgttgggtttggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 568387 - DNA, 484 bp, Homo sapiens; identical to SEQ ID NO: 535400
  misc_feature: HIJSMM301DCJIN.46.26.C04.1.454.light.4.raw

SEQ ID NO: 568388 - DNA, 501 bp, Homo sapiens
  misc_feature: HIJSMM301DD8UW.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagccctccaggctggaggatggcggtcggttttattattgtcaaactaattattttagtgtctccgtactacttttggccaggggaccaaggttggagatacaaacgaact

SEQ ID NO: 568389 - DNA, 498 bp, Homo sapiens
  misc_feature: HIJSMM301CQWCV.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaaccca

SEQ ID NO: 568390 - DNA, 489 bp, Homo sapiens; identical to SEQ ID NO: 535139
  misc_feature: HIJSMM301BQJ0J.14.55.E11.1.454.light.4.raw

SEQ ID NO: 568391 - DNA, 484 bp, Homo sapiens; identical to SEQ ID NO: 535400
  misc_feature: HIJSMM301AT6K4.46.26.C04.1.454.light.4.raw

SEQ ID NO: 568392 - DNA, 504 bp, Homo sapiens
  misc_feature: HIJSMM301EJ3PZ.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtgacagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 568393 - DNA, 503 bp, Homo sapiens
  misc_feature: HIJSMM301BP4MA.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttccg

SEQ ID NO: 568394 - DNA, 522 bp, Homo sapiens; identical to SEQ ID NO: 541090
  misc_feature: HIJSMM301CZLHT.27.23.C01.1.454.light.4.raw

SEQ ID NO: 568395 - DNA, 484 bp, Homo sapiens
  misc_feature: HIJSMM301DH92L.52.34.D01.1.454.light.4.raw
cgcagtacgacacgaccggtgctcgatttagatcgtctgtgttgggtttgggggagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattgtcagcactatggtaggtcacagtacacttttggccaggggaccaagctggaggatcaaacgaactgtggctgcaccat

SEQ ID NO: 568396 - DNA, 488 bp, Homo sapiens; identical to SEQ ID NO: 537260
  misc_feature: HIJSMM301CUSCC.47.70.G04.1.454.light.4.raw

SEQ ID NO: 568397 - DNA, 519 bp, Homo sapiens
  misc_feature: HIJSMM301DH3S1.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccccactcgtcactctcg

SEQ ID NO: 568398 - DNA, 498 bp, Homo sapiens; identical to SEQ ID NO: 545040
  misc_feature: HIJSMM301BC0QE.19.78.H01.1.454.light.4.raw

SEQ ID NO: 568399 - DNA, 506 bp, Homo sapiens
  misc_feature: HIJSMM301D67JI.2.71.G05.1.454.light.4.raw
acgctcgacacacgaccggtgctcgatttagtgtcgtcgcaagagagaggggggctcagaacgcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 568400 - DNA, 478 bp, Homo sapiens; identical to SEQ ID NO: 535129
  misc_feature: HIJSMM301DZGE4.11.11.A11.1.454.light.4.raw

SEQ ID NO: 568401 - DNA, 503 bp, Homo sapiens; identical to SEQ ID NO: 538798
  misc_feature: HIJSMM301BIB8A.14.86.H09.1.454.light.4.raw

SEQ ID NO: 568402 - DNA, 505 bp, Homo sapiens
  misc_feature: HIJSMM301DVYO6.22.46.E02.1.454.light.4.raw
acatacgcgtcacgaccggtgctcgatttagactcatctacagggaaagggggggtctcaggaggcatcactctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcta

SEQ ID NO: 568403 - DNA, 444 bp, Homo sapiens; identical to SEQ ID NO: 535594
  misc_feature: HIJSMM301BPHN8.9.9.A09.1.454.light.4.raw

SEQ ID NO: 568404 - DNA, 505 bp, Homo sapiens
  misc_feature: HIJSMM301D1FLH.2.35.D02.1.454.light.4.raw
  modified_base (375)..(375): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaatcctcatttatgaggtcactaagcggcccttaggggtccctgatcgcttctctggctccaagtctggcagaacggcctccctgaccgtntctgggctccaagctgaggatgaggctgattattactgcagctcatatgcaggcagcagcaatgtacttttcggcggtaggaccaagctgaccgtcctgggtcagcccaaggctgccccctcggtctacc

SEQ ID NO: 568405 - DNA, 484 bp, Homo sapiens; identical to SEQ ID NO: 535400
  misc_feature: HIJSMM301DFH0Q.46.26.C04.1.454.light.4.raw

SEQ ID NO: 568406 - DNA, 494 bp, Homo sapiens
  misc_feature: HIJSMM301BUYCB.12.23.C01.1.454.light.4.raw
  modified_base (199)..(199): a, c, t, g, unknown or other
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcagcagtataataactggttcctgctcactttcgggcgggggaccaaggtggagatacaaacgaactgtggctgcacatctgtt

SEQ ID NO: 568407 - DNA, 449 bp, Homo sapiens
  misc_feature: HIJSMM301AYIVQ.18.9.A09.1.454.light.4.raw
tacgagtatgcacgaccggtgctcgatttagcgagacgcgcgagggtcctgggcccagtctgtgctgacgcagccgccctcagtgtctggggccccagggcaggagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggaccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctctccatactcgta

SEQ ID NO: 568408 - DNA, 500 bp, Homo sapiens
  misc_feature: HIJSMM301AXU1K.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagctgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 568409 - DNA, 511 bp, Homo sapiens
  misc_feature: HIJSMM301BFE0P.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtccactctgttcccaccctcctcgctacgtaga

SEQ ID NO: 568410 - DNA, 507 bp, Homo sapiens; identical to SEQ ID NO: 535355
  misc_feature: HIJSMM301B05V8.9.12.B01.1.454.light.4.raw

SEQ ID NO: 568411 - DNA, 515 bp, Homo sapiens
  misc_feature: HIJSMM301EA0J7.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctgccccctcggtcactctgttcccacctcctc

SEQ ID NO: 568412 - DNA, 447 bp, Homo sapiens; identical to SEQ ID NO: 535020
  misc_feature: HIJSMM301C6Z90.18.9.A09.1.454.light.4.raw

SEQ ID NO: 568413 - DNA, 496 bp, Homo sapiens
  misc_feature: HIJSMM301C2Z9T.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccaccctcctcgagtagtaca

SEQ ID NO: 568414 - DNA, 447 bp, Homo sapiens; identical to SEQ ID NO: 549542
  misc_feature: HIJSMM301B8WBV.18.9.A09.1.454.light.4.raw

SEQ ID NO: 568415 - DNA, 504 bp, Homo sapiens
  misc_feature: HIJSMM301BNGYF.40.57.F02.1.454.light.4.raw
tctagcgactcacgaccggtgctcgatttagctcgatatagttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaagctgccctcaccattacgggggcccagccagaggatgagtcttattattactgcatgctccatgtggggggtgccgacttgggtgttcggcggagggaccaaggctgaccgtcctaggtcagcccaaggctgccccctc

SEQ ID NO: 568416 - DNA, 501 bp, Homo sapiens; identical to SEQ ID NO: 539237
  misc_feature: HIJSMM301AXP78.4.39.D06.1.454.light.4.raw

SEQ ID NO: 568417 - DNA, 504 bp, Homo sapiens
  misc_feature: HIJSMM301EUFIK.43.45.E01.1.454.light.4.raw
tgtgagtagtcacgaccggtgctcgatttagtgagtcagtaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaacggtggaaagacaaacgaactagtggctgcaccatctgtcttcatcttccccg

SEQ ID NO: 568418 - DNA, 503 bp, Homo sapiens
  misc_feature: HIJSMM301C1FZJ.12.53.E09.1.454.light.4.raw
  modified_base (453)..(453): a, c, t, g, unknown or other
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcngcccaaggctgcccctcggtcactctgtcccaccctcctctacgtcgtat

SEQ ID NO: 568419 - DNA, 491 bp, Homo sapiens
  misc_feature: HIJSMM301EDZSC.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatggtggcagtttattactgtcagcaatatgaaagtattcctttacttcggccctgggaccaaagtggatatacaaacgaactgtggctgcaccat

SEQ ID NO: 568420 - DNA, 479 bp, Homo sapiens; identical to SEQ ID NO: 542895
  misc_feature: HIJSMM301ELYA5.40.59.F04.1.454.light.4.raw

SEQ ID NO: 568421 - DNA, 485 bp, Homo sapiens; identical to SEQ ID NO: 536040
  misc_feature: HIJSMM301BZ0Z8.15.1.A01.1.454.light.4.raw

SEQ ID NO: 568422 - DNA, 490 bp, Homo sapiens; identical to SEQ ID NO: 541567
  misc_feature: HIJSMM301ARDM5.22.65.F10.1.454.light.4.raw

SEQ ID NO: 568423 - DNA, 472 bp, Homo sapiens
  misc_feature: HIJSMM301CVPUS.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctgca

SEQ ID NO: 568424 - DNA, 520 bp, Homo sapiens; identical to SEQ ID NO: 537173
  misc_feature: HIJSMM301CRIY6.27.23.C01.1.454.light.4.raw

SEQ ID NO: 568425 - DNA, 456 bp, Homo sapiens
  misc_feature: HIJSMM301DVVJP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttcccctggccatcagagggctccagtctgaagatgaggctgattattactgtgcaatctgggatgacagtgtgaacggtccggttttcggcggagggaccaaagctgaccgtcctaaagtcagcccaaggctgcccctcggtcactctgttcccgccctcctccacgagagta

SEQ ID NO: 568426 - DNA, 521 bp, Homo sapiens; identical to SEQ ID NO: 539470
  misc_feature: HIJSMM301B32KC.27.23.C01.1.454.light.4.raw

SEQ ID NO: 568427 - DNA, 494 bp, Homo sapiens; identical to SEQ ID NO: 557282
  misc_feature: HIJSMM301BK9NL.51.29.C07.1.454.light.4.raw

SEQ ID NO: 568428 - DNA, 492 bp, Homo sapiens
  misc_feature: HIJSMM301A2KL9.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcagcagactggagcctgaagattttgcaatttattactgtcaccagtatggtagttcaccttctaactttcggcggagggaccgaaggtggagatcaaacgaactgtggctgcaccatctgtcttcatt

SEQ ID NO: 568429 - DNA, 520 bp, Homo sapiens
  misc_feature: HIJSMM301BA375.27.23.C01.1.454.light.4.raw
  modified_base (508)..(508): a, c, t, g, unknown or other
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcacnctgttccgccct

SEQ ID NO: 568430 - DNA, 506 bp, Homo sapiens
  misc_feature: HIJSMM301CPBFN.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgtccccccg

SEQ ID NO: 568431 - DNA, 486 bp, Homo sapiens; identical to SEQ ID NO: 535385
  misc_feature: HIJSMM301B5DUF.19.71.G05.1.454.light.4.raw

SEQ ID NO: 568432 - DNA, 501 bp, Homo sapiens
  misc_feature: HIJSMM301C2J7P.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 568433 - DNA, 491 bp, Homo sapiens; identical to SEQ ID NO: 536988
  misc_feature: HIJSMM301CN43R.17.21.B10.1.454.light.4.raw

SEQ ID NO: 568434 - DNA, 444 bp, Homo sapiens; identical to SEQ ID NO: 549841
  misc_feature: HIJSMM301BF95A.14.76.G10.1.454.light.4.raw

SEQ ID NO: 568435 - DNA, 498 bp, Homo sapiens; identical to SEQ ID NO: 553247
  misc_feature: HIJSMM301B8QN0.40.57.F02.1.454.light.4.raw

SEQ ID NO: 568436 - DNA, 470 bp, Homo sapiens; identical to SEQ ID NO: 536130
  misc_feature: HIJSMM301CA5UX.7.81.H04.1.454.light.4.raw

SEQ ID NO: 568437 - DNA, 505 bp, Homo sapiens; identical to SEQ ID NO: 536254
  misc_feature: HIJSMM301B8V7B.7.71.G05.1.454.light.4.raw

SEQ ID NO: 568438 - DNA, 487 bp, Homo sapiens
  misc_feature: HIJSMM301BG0VY.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccccctctcactttcggtcggggggaccgaaggtggagatcaaacgaaactgtggctgcacca

SEQ ID NO: 568439 - DNA, 444 bp, Homo sapiens; identical to SEQ ID NO: 535192
  misc_feature: HIJSMM301D5WNY.5.9.A09.1.454.light.4.raw

SEQ ID NO: 568440 - DNA, 500 bp, Homo sapiens
  misc_feature: HIJSMM301CUEZH.3.33.C11.1.454.light.4.raw
agacgcactccacgaccggtgctcgatttagagtgagctcgttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctgtccccccg

SEQ ID NO: 568441 - DNA, 507 bp, Homo sapiens; identical to SEQ ID NO: 568324
  misc_feature: HIJSMM301EK2XK.19.72.G06.1.454.light.4.raw

SEQ ID NO: 568442 - DNA, 493 bp, Homo sapiens; identical to SEQ ID NO: 537422
  misc_feature: HIJSMM301EWQUF.9.34.D01.1.454.light.4.raw

SEQ ID NO: 568443 - DNA, 499 bp, Homo sapiens; identical to SEQ ID NO: 547972
  misc_feature: HIJSMM301BP1S3.8.2.A02.1.454.light.4.raw

SEQ ID NO: 568444 - DNA, 518 bp, Homo sapiens; identical to SEQ ID NO: 563314
  misc_feature: HIJSMM301BV8ZX.14.70.G04.1.454.light.4.raw

SEQ ID NO: 568445 - DNA, 498 bp, Homo sapiens; identical to SEQ ID NO: 544837
  misc_feature: HIJSMM301CQ5AR.11.71.G05.1.454.light.4.raw

SEQ ID NO: 568446 - DNA, 500 bp, Homo sapiens
  misc_feature: HIJSMM301BKYJ7.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctgtgtctccaggggaaagagccaccctctcctgcagggccagtcagagtcttagcggcaccttagcctggtaccagcagaaacctgaccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggcctccgcgtggacgtcggtcgacggacgaacggaggaagtacaaacgaaactagtggcgtgcaccactctgtcttctat

SEQ ID NO: 568447 - DNA, 510 bp, Homo sapiens
  misc_feature: HIJSMM301DVABC.52.87.H10.1.454.light.4.raw
cgcagtacgacacgaccggtgctcgatttagcagtactgcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggtttcgcggagggaccaaggtgaccgtctacgtcagcccaaggctgccccctggtcact

SEQ ID NO: 568448 - DNA, 506 bp, Homo sapiens
  misc_feature: HIJSMM301ADKG5.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgccaggacgaacggtaggaagtacaagacgaacacgtggcgtgcgacactctgtcttctactcttccgt

SEQ ID NO: 568449 - DNA, 485 bp, Homo sapiens; identical to SEQ ID NO: 536210
  misc_feature: HIJSMM301AKSK0.43.54.E10.1.454.light.4.raw

SEQ ID NO: 568450 - DNA, 481 bp, Homo sapiens
  misc_feature: HIJSMM301BJWOU.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggacctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 568451 - DNA, 496 bp, Homo sapiens; identical to SEQ ID NO: 548004
  misc_feature: HIJSMM301DWPVM.3.35.D02.1.454.light.4.raw

SEQ ID NO: 568452 - DNA, 483 bp, Homo sapiens; identical to SEQ ID NO: 538138
  misc_feature: HIJSMM301CYHLR.41.34.D01.1.454.light.4.raw

SEQ ID NO: 568453 - DNA, 492 bp, Homo sapiens
  misc_feature: HIJSMM301B67AN.9.1.A01.1.454.light.4.raw
  modified_base (474)..(474): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcgccaaggacacgactggagataaggtaactagtggctgcaccanctgtcttcatcttccccg

SEQ ID NO: 568454 - DNA, 496 bp, Homo sapiens; identical to SEQ ID NO: 540261
  misc_feature: HIJSMM301C3M4L.3.78.H01.1.454.light.4.raw

SEQ ID NO: 568455 - DNA, 498 bp, Homo sapiens; identical to SEQ ID NO: 539641
  misc_feature: HIJSMM301DKHFI.22.27.C05.1.454.light.4.raw

SEQ ID NO: 568456 - DNA, 494 bp, Homo sapiens
  misc_feature: HIJSMM301DA1HQ.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcact

SEQ ID NO: 568457 - DNA, 487 bp, Homo sapiens
  misc_feature: HIJSMM301AIYQ2.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctactacttttggccaggggacaagctggagatcaaacgaa

SEQ ID NO: 568458 - DNA, 506 bp, Homo sapiens; identical to SEQ ID NO: 557726
  misc_feature: HIJSMM301BDVHU.47.83.H06.1.454.light.4.raw

SEQ ID NO: 568459 - DNA, 488 bp, Homo sapiens; identical to SEQ ID NO: 544026
  misc_feature: HIJSMM301AIJ5S.14.55.E11.1.454.light.4.raw

SEQ ID NO: 568460 - DNA, 478 bp, Homo sapiens; identical to SEQ ID NO: 541928
  misc_feature: HIJSMM301B97C2.7.76.G10.1.454.light.4.raw

SEQ ID NO: 568461 - DNA, 506 bp, Homo sapiens
  misc_feature: HIJSMM301AGWWG.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctcgggaccaaagtggatatcaaacgaactagtggctgcaccatctgtctt

SEQ ID NO: 568462 - DNA, 503 bp, Homo sapiens; identical to SEQ ID NO: 538973
  misc_feature: HIJSMM301AN1RG.5.86.H09.1.454.light.4.raw

SEQ ID NO: 568463 - DNA, 442 bp, Homo sapiens
  misc_feature: HIJSMM301BC1L8.48.55.E11.1.454.light.4.raw
agtatacatacacgaccggtgctcgatttagcactcgcacgttgggtttggggggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctggtcactctgttcccgcctcctctatgtatact

SEQ ID NO: 568464 - DNA, 495 bp, Homo sapiens
  misc_feature: HIJSMM301AV7GP.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaaggctgaccgtcctgggtcagcccaaggctgccccctcggtcact

SEQ ID NO: 568465 - DNA, 354 bp, Homo sapiens; identical to SEQ ID NO: 535026
  misc_feature: HIJSMM301AS4AK.19.22.B11.1.454.light.4.raw

SEQ ID NO: 568466 - DNA, 484 bp, Homo sapiens
  misc_feature: HIJSMM301AYAC5.49.34.D01.1.454.light.4.raw
agtcgagagacacgaccggtgctcgatttagatcgtctgtgttgggtttgggggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccatctgt

SEQ ID NO: 568467 - DNA, 487 bp, Homo sapiens
  misc_feature: HIJSMM301DIUSD.51.73.G07.1.454.light.4.raw
cgatcgtatacacgaccggtgctcgatttagctctacgctcagggggagtcagtctcagtcaggacacagcatggacatgagggtccccgctcagctcctggggctcctgctactctggctccgaggtgccagatgtgccatccagttgacccagtctccatcctccctgtctgcatctgttggagaagtagtcgccatcacttgccagacaagacagacccttagtacatatttaaactggtatcaacagaagccagggaggccccctaaactcataatctatggtgcctccactttgcaaagtggagtcccgtcaaggttcagtggcactggagctgggacagatttcagtctcgtcatccacggcctgcaacttgaggatgttgcgacttactactgtcaagaggctgccactattcctccgtacactttcggccaggggaccaaggtggagatcagacgaactgtggctgcaccatctgtctt

SEQ ID NO: 568468 - DNA, 499 bp, Homo sapiens; identical to SEQ ID NO: 551769
  misc_feature: HIJSMM301EUTOY.43.34.D01.1.454.light.4.raw

SEQ ID NO: 568469 - DNA, 488 bp, Homo sapiens; identical to SEQ ID NO: 537260
  misc_feature: HIJSMM301APHSF.47.70.G04.1.454.light.4.raw

SEQ ID NO: 568470 - DNA, 503 bp, Homo sapiens
  misc_feature: HIJSMM301EEGJA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccaaggtaggaaatcaaacgaactagtggctgcaccatctgtcttcatcttccccg

SEQ ID NO: 568471 - DNA, 478 bp, Homo sapiens
  misc_feature: HIJSMM301BT2T0.10.20.B09.1.454.light.4.raw
  modified_base (367)..(367): a, c, t, g, unknown or other
  modified_base (472)..(472): a, c, t, g, unknown or other
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagnggcctgcagtctgaagattttgcagtttattactgtcagcagtataatgactgggttttattcacttcgtccgtcggacgaacgaagagttatagacgaatacgnggtgtg

SEQ ID NO: 568472 - DNA, 503 bp, Homo sapiens; identical to SEQ ID NO: 538884
  misc_feature: HIJSMM301BVKLS.27.78.H01.1.454.light.4.raw

SEQ ID NO: 568473 - DNA, 481 bp, Homo sapiens; identical to SEQ ID NO: 535628
  misc_feature: HIJSMM301CP4TX.14.11.A11.1.454.light.4.raw

SEQ ID NO: 568474 - DNA, 479 bp, Homo sapiens; identical to SEQ ID NO: 558787
  misc_feature: HIJSMM301EGU23.11.17.B06.1.454.light.4.raw

SEQ ID NO: 568475 - DNA, 482 bp, Homo sapiens; identical to SEQ ID NO: 550464
  misc_feature: HIJSMM301C82EV.13.50.E06.1.454.light.4.raw

SEQ ID NO: 568476 - DNA, 493 bp, Homo sapiens
  misc_feature: HIJSMM301BX1WZ.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacagtacccccccacgtcggtcggaggacgacagcgtacgatacaacgaaacgtcgtggcgtcgcaccactctcg

SEQ ID NO: 568477 - DNA, 502 bp, Homo sapiens
  misc_feature: HIJSMM301EOPIW.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcatttcaagttcctttttgtcttcggaactggaccgaggtcaccgtcctaggtcagcccaaggccaaccccactcgtca

SEQ ID NO: 568478 - DNA, 503 bp, Homo sapiens; identical to SEQ ID NO: 536834
  misc_feature: HIJSMM301BAQYA.2.35.D02.1.454.light.4.raw

SEQ ID NO: 568479 - DNA, 504 bp, Homo sapiens
  misc_feature: HIJSMM301DZYI2.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagagtcaaacgaactgtggctgcaccatctgtcttcatctccgccat

SEQ ID NO: 568480 - DNA, 486 bp, Homo sapiens; identical to SEQ ID NO: 535385
  misc_feature: HIJSMM301C82U0.19.71.G05.1.454.light.4.raw

SEQ ID NO: 568481 - DNA, 484 bp, Homo sapiens; identical to SEQ ID NO: 535400
  misc_feature: HIJSMM301AZRBS.46.26.C04.1.454.light.4.raw

SEQ ID NO: 568482 - DNA, 489 bp, Homo sapiens; identical to SEQ ID NO: 535139
  misc_feature: HIJSMM301C2Z15.14.55.E11.1.454.light.4.raw

SEQ ID NO: 568483 - DNA, 520 bp, Homo sapiens
  misc_feature: HIJSMM301CFTCT.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtccactctgttcccaccctcctcaccg

SEQ ID NO: 568484 - DNA, 493 bp, Homo sapiens
  misc_feature: HIJSMM301DZRW7.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcat

SEQ ID NO: 568485 - DNA, 520 bp, Homo sapiens
  misc_feature: HIJSMM301C0P9Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 568486 - DNA, 495 bp, Homo sapiens; identical to SEQ ID NO: 543094
  misc_feature: HIJSMM301D7B5Y.22.57.F02.1.454.light.4.raw

SEQ ID NO: 568487 - DNA, 488 bp, Homo sapiens; identical to SEQ ID NO: 563619
  misc_feature: HIJSMM301A3BP7.3.55.E11.1.454.light.4.raw

SEQ ID NO: 568488 - DNA, 511 bp, Homo sapiens
  misc_feature: HIJSMM301BYYQ4.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagccccaaggctcgccccctcggtcactctgttccca

SEQ ID NO: 568489 - DNA, 492 bp, Homo sapiens
  misc_feature: HIJSMM301ETQA4.49.57.F02.1.454.light.4.raw
agtcgagagacacgaccggtgctcgatttagctcgatatagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 568490 - DNA, 486 bp, Homo sapiens; identical to SEQ ID NO: 535043
  misc_feature: HIJSMM301A7IUT.46.35.D02.1.454.light.4.raw

SEQ ID NO: 568491 - DNA, 494 bp, Homo sapiens; identical to SEQ ID NO: 536221
  misc_feature: HIJSMM301ERUWS.15.59.F04.1.454.light.4.raw

SEQ ID NO: 568492 - DNA, 471 bp, Homo sapiens; identical to SEQ ID NO: 539388
  misc_feature: HIJSMM301AEQ14.13.39.D06.1.454.light.4.raw

SEQ ID NO: 568493 - DNA, 491 bp, Homo sapiens; identical to SEQ ID NO: 535294
  misc_feature: HIJSMM301AOWW9.16.68.G02.1.454.light.4.raw

SEQ ID NO: 568494 - DNA, 486 bp, Homo sapiens; identical to SEQ ID NO: 536261
  misc_feature: HIJSMM301A0JKQ.26.55.E11.1.454.light.4.raw

SEQ ID NO: 568495 - DNA, 495 bp, Homo sapiens
  misc_feature: HIJSMM301AI1MA.51.69.G03.1.454.light.4.raw
cgatcgtatacacgaccggtgctcgatttagtcgctgcgtaaaggagaaaggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttattggtggtgttcggcggagggaccaaggtgacccg

SEQ ID NO: 568496 - DNA, 518 bp, Homo sapiens; identical to SEQ ID NO: 564399
  misc_feature: HIJSMM301ERFAD.9.2.A02.1.454.light.4.raw

SEQ ID NO: 568497 - DNA, 488 bp, Homo sapiens; identical to SEQ ID NO: 537260
  misc_feature: HIJSMM301CK740.47.70.G04.1.454.light.4.raw

SEQ ID NO: 568498 - DNA, 494 bp, Homo sapiens; identical to SEQ ID NO: 536444
  misc_feature: HIJSMM301D1XXV.26.72.G06.1.454.light.4.raw

SEQ ID NO: 568499 - DNA, 416 bp, Homo sapiens; identical to SEQ ID NO: 545902
  misc_feature: HIJSMM301CVGCS.18.78.H01.1.454.light.4.raw

SEQ ID NO: 568500 - DNA, 495 bp, Homo sapiens
  misc_feature: HIJSMM301ENXP1.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctcg

SEQ ID NO: 568501 - DNA, 477 bp, Homo sapiens
  misc_feature: HIJSMM301A3YPC.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcgccaggaccgaggtggaaagtacaaacgaacagtgcgtgcacac

SEQ ID NO: 568502 - DNA, 479 bp, Homo sapiens; identical to SEQ ID NO: 536050
  misc_feature: HIJSMM301B864H.5.73.G07.1.454.light.4.raw

SEQ ID NO: 568503 - DNA, 513 bp, Homo sapiens; identical to SEQ ID NO: 564131
  misc_feature: HIJSMM301CIOGZ.14.78.H01.1.454.light.4.raw

SEQ ID NO: 568504 - DNA, 444 bp, Homo sapiens; identical to SEQ ID NO: 535027
  misc_feature: HIJSMM301BEEWJ.8.73.G07.1.454.light.4.raw

SEQ ID NO: 568505 - DNA, 481 bp, Homo sapiens; identical to SEQ ID NO: 553013
  misc_feature: HIJSMM301D5NEG.8.12.B01.1.454.light.4.raw

SEQ ID NO: 568506 - DNA, 486 bp, Homo sapiens; identical to SEQ ID NO: 535385
  misc_feature: HIJSMM301EA12C.19.71.G05.1.454.light.4.raw

SEQ ID NO: 568507 - DNA, 483 bp, Homo sapiens; identical to SEQ ID NO: 536836
  misc_feature: HIJSMM301AZXLX.3.38.D05.1.454.light.4.raw

SEQ ID NO: 568508 - DNA, 515 bp, Homo sapiens
  misc_feature: HIJSMM301DXANK.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccaccctcct

SEQ ID NO: 568509 - DNA, 485 bp, Homo sapiens; identical to SEQ ID NO: 540394
  misc_feature: HIJSMM301CQ3D2.46.26.C04.1.454.light.4.raw

SEQ ID NO: 568510 - DNA, 504 bp, Homo sapiens; identical to SEQ ID NO: 535077
  misc_feature: HIJSMM301AX8NB.8.28.C06.1.454.light.4.raw

SEQ ID NO: 568511 - DNA, 495 bp, Homo sapiens
  misc_feature: HIJSMM301B3371.43.38.D05.1.454.light.4.raw
tgtgagtagtcacgaccggtgctcgatttagtatctgatagttgggtttggggcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcacg

SEQ ID NO: 568512 - DNA, 482 bp, Homo sapiens; identical to SEQ ID NO: 549843
  misc_feature: HIJSMM301BSEWE.3.38.D05.1.454.light.4.raw

SEQ ID NO: 568513 - DNA, 498 bp, Homo sapiens; identical to SEQ ID NO: 535974
  misc_feature: HIJSMM301DBW2G.22.27.C05.1.454.light.4.raw

SEQ ID NO: 568514 - DNA, 512 bp, Homo sapiens; identical to SEQ ID NO: 552150
  misc_feature: HIJSMM301C31NH.17.33.C11.1.454.light.4.raw

SEQ ID NO: 568515 - DNA, 503 bp, Homo sapiens; identical to SEQ ID NO: 538884
  misc_feature: HIJSMM301ENY8B.27.78.H01.1.454.light.4.raw

SEQ ID NO: 568516 - DNA, 509 bp, Homo sapiens
  misc_feature: HIJSMM301DQWO3.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactcgtggctgcaccatctgtcttcatcttcccgtccatt

SEQ ID NO: 568517 - DNA, 501 bp, Homo sapiens; identical to SEQ ID NO: 535746
  misc_feature: HIJSMM301A9VS4.18.11.A11.1.454.light.4.raw

SEQ ID NO: 568518 - DNA, 481 bp, Homo sapiens
  misc_feature: HIJSMM301EJZJH.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattaactgtcaacagtatgatagtctggccgccttcggccggagggaccgaaggtggagatcgaacgaactagtggctgca

SEQ ID NO: 568519 - DNA, 504 bp, Homo sapiens; identical to SEQ ID NO: 535128
  misc_feature: HIJSMM301AGNBO.19.85.H08.1.454.light.4.raw

SEQ ID NO: 568520 - DNA, 489 bp, Homo sapiens
  misc_feature: HIJSMM301BO633.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatggtagctcaccgtacacttttggccaggggaccaagctggagatcaaacgaactgtggctgcaccatctgtcttcta

SEQ ID NO: 568521 - DNA, 484 bp, Homo sapiens
  misc_feature: HIJSMM301D4DJG.40.15.B04.1.454.light.4.raw
tctagcgactcacgaccggtgctcgatttagacagtatatatccgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccaagctgaccgtcctaggtcacg

SEQ ID NO: 568522 - DNA, 498 bp, Homo sapiens; identical to SEQ ID NO: 547944
  misc_feature: HIJSMM301EG835.41.53.E09.1.454.light.4.raw

SEQ ID NO: 568523 - DNA, 485 bp, Homo sapiens; identical to SEQ ID NO: 538194
  misc_feature: HIJSMM301BNAWS.47.62.F07.1.454.light.4.raw

SEQ ID NO: 568524 - DNA, 488 bp, Homo sapiens; identical to SEQ ID NO: 537260
  misc_feature: HIJSMM301CABC0.47.70.G04.1.454.light.4.raw

SEQ ID NO: 568525 - DNA, 496 bp, Homo sapiens
  misc_feature: HIJSMM301CV78E.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgccactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 568526 - DNA, 489 bp, Homo sapiens
  misc_feature: HIJSMM301A140B.48.27.C05.1.454.light.4.raw
agtatacatacacgaccggtgctcgatttagacgcgatcgaagggtttgggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 568527 - DNA, 473 bp, Homo sapiens; identical to SEQ ID NO: 535262
  misc_feature: HIJSMM301A15TT.8.67.G01.1.454.light.4.raw

SEQ ID NO: 568528 - DNA, 441 bp, Homo sapiens; identical to SEQ ID NO: 534971
  misc_feature: HIJSMM301CPEEP.11.3.A03.1.454.light.4.raw

SEQ ID NO: 568529 - DNA, 505 bp, Homo sapiens
  misc_feature: HIJSMM301DOGGE.49.47.E03.1.454.light.4.raw
agtcgagagacacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgagggggtcttcggcggagggaccaagctgaccgtcctaggtcagcccaaggctgccccctcggtcactctgttccc

SEQ ID NO: 568530 - DNA, 505 bp, Homo sapiens; identical to SEQ ID NO: 555429
  misc_feature: HIJSMM301C3KIJ.4.71.G05.1.454.light.4.raw

SEQ ID NO: 568531 - DNA, 497 bp, Homo sapiens
  misc_feature: HIJSMM301AE1TW.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggaggatcaaacgaactgtggctgcaccatctgtctt

SEQ ID NO: 568532 - DNA, 510 bp, Homo sapiens
  misc_feature: HIJSMM301DEBXN.51.38.D05.1.454.light.4.raw
cgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcg

SEQ ID NO: 568533 - DNA, 500 bp, Homo sapiens; identical to SEQ ID NO: 564675
  misc_feature: HIJSMM301EK364.43.34.D01.1.454.light.4.raw

SEQ ID NO: 568534 - DNA, 497 bp, Homo sapiens; identical to SEQ ID NO: 535664
  misc_feature: HIJSMM301EE4TK.22.14.B03.1.454.light.4.raw

SEQ ID NO: 568535 - DNA, 383 bp, Homo sapiens; identical to SEQ ID NO: 447524
  misc_feature: HIJSMM301AT1S6.41.26.C04.1.454.light.4.raw

SEQ ID NO: 568536 - DNA, 512 bp, Homo sapiens; identical to SEQ ID NO: 552150
  misc_feature: HIJSMM301DKHA4.17.33.C11.1.454.light.4.raw

SEQ ID NO: 568537 - DNA, 497 bp, Homo sapiens; identical to SEQ ID NO: 535286
  misc_feature: HIJSMM301BGFLF.18.59.F04.1.454.light.4.raw

SEQ ID NO: 568538 - DNA, 506 bp, Homo sapiens
  misc_feature: HIJSMM301B2S46.49.78.H01.1.454.light.4.raw
agtcgagagacacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatcccaccagggccactggtatcccagccaggttcagtggcagtgggtctgggacagtagttcactctcaccatcagcagcctgcagtctgaagattttgctagttttattactgtcagcagtataatggtccgggctccggactactttcggcggacgggaccgaagggtggagatacaaaacgaactgtggctgccaccatctgtt

SEQ ID NO: 568539 - DNA, 525 bp, Homo sapiens
  misc_feature: HIJSMM301ATE0L.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaacggccaaccccacctgtcactctcgtttccgccctccctccgtcgtc

SEQ ID NO: 568540 - DNA, 505 bp, Homo sapiens
  misc_feature: HIJSMM301DAJAE.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagactgaccgtcctgggtcagcccaaggctgccccctccggt

SEQ ID NO: 568541 - DNA, 516 bp, Homo sapiens
  misc_feature: HIJSMM301A269U.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttctcg

SEQ ID NO: 568542 - DNA, 492 bp, Homo sapiens
  misc_feature: HIJSMM301C91LW.10.17.B06.1.454.light.4.raw
catagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 568543 - DNA, 486 bp, Homo sapiens
  misc_feature: HIJSMM301A9OM4.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaggaccgaacggtggaaatacaaacgaactacgtggctgcacca

SEQ ID NO: 568544 - DNA, 495 bp, Homo sapiens
  misc_feature: HIJSMM301BCEZ1.40.50.E06.1.454.light.4.raw
tctagcgactcacgaccggtgctcgatttagatctactgacaacacacaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgccccttatgtcttcgggactgggaccaaggtcacagtcctaggtcagcccaagg

SEQ ID NO: 568545 - DNA, 496 bp, Homo sapiens; identical to SEQ ID NO: 535109
  misc_feature: HIJSMM301AIN0Z.16.78.H01.1.454.light.4.raw

SEQ ID NO: 568546 - DNA, 512 bp, Homo sapiens
  misc_feature: HIJSMM301DULMR.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccgggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggt

SEQ ID NO: 568547 - DNA, 491 bp, Homo sapiens; identical to SEQ ID NO: 536211
  misc_feature: HIJSMM301EOX7O.16.53.E09.1.454.light.4.raw

SEQ ID NO: 568548 - DNA, 511 bp, Homo sapiens; identical to SEQ ID NO: 541549
  misc_feature: HIJSMM301EJEDR.40.33.C11.1.454.light.4.raw

SEQ ID NO: 568549 - DNA, 511 bp, Homo sapiens
  misc_feature: HIJSMM301ADDWT.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttgggcaggggacccaggtggagatcagactgatattaacagcgaaaagagattttgttaaggggaaagtaatgaagttaa

SEQ ID NO: 568550 - DNA, 505 bp, Homo sapiens; identical to SEQ ID NO: 536233
  misc_feature: HIJSMM301AMOQJ.48.25.C03.1.454.light.4.raw

SEQ ID NO: 568551 - DNA, 490 bp, Homo sapiens
  misc_feature: HIJSMM301E10B0.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccccactttcggccctgggaccgaaagtaggatatcaaacgaaactgtggctgcaccatctgtt

SEQ ID NO: 568552 - DNA, 524 bp, Homo sapiens
  misc_feature: HIJSMM301BQORM.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtggtgggagactaattttggtcatatgttgttcggcgggagggaccgaagctgaccgtcctcggtcagcccaaggctcgccccctcggtcactctgttcccaccctcctcc

SEQ ID NO: 568553 - DNA, 460 bp, Homo sapiens
  misc_feature: HIJSMM301B8PFT.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggaggtaccaagctgaccgtcctaggtcagcccaaggctgccccctcggtcactctgttcccaccctcctcgtatctctcg

SEQ ID NO: 568554 - DNA, 498 bp, Homo sapiens; identical to SEQ ID NO: 535295
  misc_feature: HIJSMM301DIZ99.15.25.C03.1.454.light.4.raw

SEQ ID NO: 568555 - DNA, 507 bp, Homo sapiens; identical to SEQ ID NO: 535641
  misc_feature: HIJSMM301AVZ04.10.88.H11.1.454.light.4.raw

SEQ ID NO: 568556 - DNA, 488 bp, Homo sapiens
  misc_feature: HIJSMM301C82T8.48.57.F02.1.454.light.4.raw
agtatacatacacgaccggtgctcgatttagctcgatatagttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggaggggaccgaaacgactgaccgtccctaaagtcagacccaac

SEQ ID NO: 568557 - DNA, 497 bp, Homo sapiens; identical to SEQ ID NO: 536371
  misc_feature: HIJSMM301BNICV.16.78.H01.1.454.light.4.raw

SEQ ID NO: 568558 - DNA, 485 bp, Homo sapiens
  misc_feature: HIJSMM301BG9R1.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctctcgatgaggctgactattactgccaggcgtgggacagctccacttcccgttatgtcttcggaggtgggaccatggtcaccgtcctaggtcagcccaagaccaacccc

SEQ ID NO: 568559 - DNA, 474 bp, Homo sapiens; identical to SEQ ID NO: 568211
  misc_feature: HIJSMM301DXLEA.18.76.G10.1.454.light.4.raw

SEQ ID NO: 568560 - DNA, 513 bp, Homo sapiens; identical to SEQ ID NO: 535244
  misc_feature: HIJSMM301AIJTD.17.33.C11.1.454.light.4.raw

SEQ ID NO: 568561 - DNA, 501 bp, Homo sapiens
  misc_feature: HIJSMM301D5EX3.49.67.G01.1.454.light.4.raw
agtcgagagacacgaccggtgctcgatttagagtatacatattggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgctgcgtccagcagggccactggcatcccggacaggttcagtggcagtgggtctgggacagacttctctctcaccatcagcagactggagcctgaagattttgcagtttattactgtcagcagtataatgtccgggctccggacactttcggcggagggaccaaggtggaggatacaaacgaaactgtggctgcaccatctgtcttcatt

SEQ ID NO: 568562 - DNA, 485 bp, Homo sapiens
  misc_feature: HIJSMM301CLMTK.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacacgactggagattaaacgaactgtggctgcaccatctgtt

SEQ ID NO: 568563 - DNA, 506 bp, Homo sapiens
  misc_feature: HIJSMM301AHGFY.22.15.B04.1.454.light.4.raw
acatacgcgtcacgaccggtgctcgatttagacagtatatatccgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggcctgccccctcggtcta

SEQ ID NO: 568564 - DNA, 490 bp, Homo sapiens
  misc_feature: HIJSMM301CLO8D.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattacaattaccctcgtacgttcggccaagggaccaaggtggaaatcaaacgaactgtggctgcaccatctgtctt

SEQ ID NO: 568565 - DNA, 447 bp, Homo sapiens; identical to SEQ ID NO: 535020
  misc_feature: HIJSMM301A7CDO.18.9.A09.1.454.light.4.raw

SEQ ID NO: 568566 - DNA, 493 bp, Homo sapiens
  misc_feature: HIJSMM301C042G.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgttaatttcggtggagggaccgaaggtggaggtcaaacgaactgtggctgcaccatctgtcttcatt

SEQ ID NO: 568567 - DNA, 493 bp, Homo sapiens; identical to SEQ ID NO: 556851
  misc_feature: HIJSMM301CORX9.52.10.A10.1.454.light.4.raw

SEQ ID NO: 568568 - DNA, 506 bp, Homo sapiens; identical to SEQ ID NO: 534969
  misc_feature: HIJSMM301A7E7N.18.37.D04.1.454.light.4.raw

SEQ ID NO: 568569 - DNA, 511 bp, Homo sapiens
  misc_feature: HIJSMM301BPBRW.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtcgggctccggtccgaggatgaggctgattattactgtgcaccgtgggatgacatcctgaatggtccggtgttcggcggagggaccaggctgaccgtctaagtcagcccaaggctcgcccccc

SEQ ID NO: 568570 - DNA, 505 bp, Homo sapiens; identical to SEQ ID NO: 535503
  misc_feature: HIJSMM301BHUA9.8.28.C06.1.454.light.4.raw

SEQ ID NO: 568571 - DNA, 472 bp, Homo sapiens
  misc_feature: HIJSMM301AD22G.3.82.H05.1.454.light.4.raw
agacgcactccacgaccggtgctcgatttagtcgagctctctcgcgggggcaggagtcagacccagtcaggacacagcatggacatggacgggtccccgctcagctcctggggctcctgctgctctggttcccaggttccagatgcgacatccagatgacccagtctccatcctccgtgtctgcatctggtaggggacagagtcgctatgacttgtcgggcgactcgcggttttaacagatggttagtctggtatcagcagaaaccagggaaacgcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctccgctcactttcggcggagggaccaaggtggagatcaaacgaa

SEQ ID NO: 568572 - DNA, 489 bp, Homo sapiens; identical to SEQ ID NO: 535139
  misc_feature: HIJSMM301DJ4NY.14.55.E11.1.454.light.4.raw

SEQ ID NO: 568573 - DNA, 506 bp, Homo sapiens
  misc_feature: HIJSMM301D2GHR.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaagtacaaacgaactagtggctgcaccta

SEQ ID NO: 568574 - DNA, 504 bp, Homo sapiens; identical to SEQ ID NO: 535561
  misc_feature: HIJSMM301BN7ZU.4.57.F02.1.454.light.4.raw

SEQ ID NO: 568575 - DNA, 485 bp, Homo sapiens; identical to SEQ ID NO: 535652
  misc_feature: HIJSMM301AJ21S.19.71.G05.1.454.light.4.raw

SEQ ID NO: 568576 - DNA, 513 bp, Homo sapiens
  misc_feature: HIJSMM301BR8A4.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaactgaccgtcctaggtcagcccaaggctcgccccctcggtccactctcgttcccaccctcctcgctacgtaga

SEQ ID NO: 568577 - DNA, 510 bp, Homo sapiens
  misc_feature: HIJSMM301BT3SZ.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccactctcct

SEQ ID NO: 568578 - DNA, 507 bp, Homo sapiens
  misc_feature: HIJSMM301DWX7L.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctcgccccctcggt

SEQ ID NO: 568579 - DNA, 480 bp, Homo sapiens
  misc_feature: HIJSMM301DAYFX.43.87.H10.1.454.light.4.raw
tgtgagtagtcacgaccggtgctcgatttagcagtactgcgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtccta

SEQ ID NO: 568580 - DNA, 509 bp, Homo sapiens; identical to SEQ ID NO: 550053
  misc_feature: HIJSMM301AHEXV.8.33.C11.1.454.light.4.raw

SEQ ID NO: 568581 - DNA, 518 bp, Homo sapiens; identical to SEQ ID NO: 539372
  misc_feature: HIJSMM301EZ7GW.7.86.H09.1.454.light.4.raw

SEQ ID NO: 568582 - DNA, 493 bp, Homo sapiens
  misc_feature: HIJSMM301BCV25.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggggaccgaagctgaccgtcctcggtcagcccaaggctgccccctccggt

SEQ ID NO: 568583 - DNA, 494 bp, Homo sapiens; identical to SEQ ID NO: 554249
  misc_feature: HIJSMM301CWYI8.10.33.C11.1.454.light.4.raw

SEQ ID NO: 568584 - DNA, 499 bp, Homo sapiens
  misc_feature: HIJSMM301A88NG.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagcccaaggctgcccctcggtca

SEQ ID NO: 568585 - DNA, 521 bp, Homo sapiens
  misc_feature: HIJSMM301CETSQ.27.23.C01.1.454.light.4.raw
  modified_base (239)..(239): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtncttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctcgccccctcggtcactctcgttcccaccct

SEQ ID NO: 568586 - DNA, 487 bp, Homo sapiens
  misc_feature: HIJSMM301EGZW3.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtaggagatcaaacgaa

SEQ ID NO: 568587 - DNA, 476 bp, Homo sapiens; identical to SEQ ID NO: 538026
  misc_feature: HIJSMM301ECZ53.13.76.G10.1.454.light.4.raw

SEQ ID NO: 568588 - DNA, 483 bp, Homo sapiens
  misc_feature: HIJSMM301BTYV8.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtcctaggtcagcccaaggctgccccctggtcta

SEQ ID NO: 568589 - DNA, 486 bp, Homo sapiens; identical to SEQ ID NO: 535043
  misc_feature: HIJSMM301BYVZ8.46.35.D02.1.454.light.4.raw

SEQ ID NO: 568590 - DNA, 494 bp, Homo sapiens; identical to SEQ ID NO: 539922
  misc_feature: HIJSMM301ASWQ4.27.78.H01.1.454.light.4.raw

SEQ ID NO: 568591 - DNA, 489 bp, Homo sapiens; identical to SEQ ID NO: 554439
  misc_feature: HIJSMM301C9KIJ.14.55.E11.1.454.light.4.raw
  modified_base (427)..(427): a, c, t, g, unknown or other

SEQ ID NO: 568592 - DNA, 488 bp, Homo sapiens
  misc_feature: HIJSMM301D2YBT.53.22.B11.1.454.light.4.raw
cgcgtatacacacgaccggtgctcgatttagacgacagctcaggggggggaggcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggactgcgaccaaggtcaccgtcctggtcagcccaac

SEQ ID NO: 568593 - DNA, 512 bp, Homo sapiens; identical to SEQ ID NO: 542831
  misc_feature: HIJSMM301BOWM5.43.19.B08.1.454.light.4.raw

SEQ ID NO: 568594 - DNA, 504 bp, Homo sapiens
  misc_feature: HIJSMM301DLFF6.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggcctccggtccgaggatgaggctgactattactgtgcatcacgggacgcaacatgggatgacaatctgagcggttgggtgttcggcggagggaccaaacgtgaccgtcctaggtcagcccaa

SEQ ID NO: 568595 - DNA, 539 bp, Homo sapiens
  misc_feature: HIJSMM301CWED0.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgttcagcagcgtagcaggtggcctttcacttcggtcccgggacccggaacgtaggaaagtaacaaacgaaacctaagtggtcgtggcacccaactcctcgttcttcctattccttcccgttcccacctt

SEQ ID NO: 568596 - DNA, 485 bp, Homo sapiens
  misc_feature: HIJSMM301D6WCQ.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggccaagctgaccgtcctaggtcacg

SEQ ID NO: 568597 - DNA, 504 bp, Homo sapiens
  misc_feature: HIJSMM301B72A1.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccgaagggaccaaggtggaaatcaaaacgaacctagtggctgcaccatctgtcttcatcttccccg

SEQ ID NO: 568598 - DNA, 480 bp, Homo sapiens
  misc_feature: HIJSMM301CLUXE.47.62.F07.1.454.light.4.raw
  modified_base (451)..(451): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccacttcgcctggaccaagtaganatcaaacgaactgtgctgcaccatctgtt

SEQ ID NO: 568599 - DNA, 505 bp, Homo sapiens; identical to SEQ ID NO: 535987
  misc_feature: HIJSMM301B9M90.18.37.D04.1.454.light.4.raw

SEQ ID NO: 568600 - DNA, 476 bp, Homo sapiens; identical to SEQ ID NO: 538026
  misc_feature: HIJSMM301C5MHF.13.76.G10.1.454.light.4.raw

SEQ ID NO: 568601 - DNA, 479 bp, Homo sapiens
  misc_feature: HIJSMM301DGJQG.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcgagggtggaggctgaggatgttattgggctctattattgcatgcaagcaacacactggccgtacacttttggccagggaccaagctggagatcaatcgaa

SEQ ID NO: 568602 - DNA, 496 bp, Homo sapiens; identical to SEQ ID NO: 564830
  misc_feature: HIJSMM301B6GYR.3.71.G05.1.454.light.4.raw

SEQ ID NO: 568603 - DNA, 516 bp, Homo sapiens
  misc_feature: HIJSMM301CGINZ.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 568604 - DNA, 494 bp, Homo sapiens
  misc_feature: HIJSMM301CAFSF.41.38.D05.1.454.light.4.raw
  modified_base (480)..(480): a, c, t, g, unknown or other
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcnccatctgtcttcat

SEQ ID NO: 568605 - DNA, 486 bp, Homo sapiens; identical to SEQ ID NO: 536555
  misc_feature: HIJSMM301AXWT1.26.23.C01.1.454.light.4.raw

SEQ ID NO: 568606 - DNA, 494 bp, Homo sapiens
  misc_feature: HIJSMM301D85T9.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaacgggaccaaggtggaagtacaaacgaactagtggctgcaccatctgtctt

SEQ ID NO: 568607 - DNA, 514 bp, Homo sapiens
  misc_feature: HIJSMM301BJD22.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtccgtgggtcagcccaaggctcgccccctcggtcactctgttcccgcct

SEQ ID NO: 568608 - DNA, 504 bp, Homo sapiens
  misc_feature: HIJSMM301BZ7CI.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcgg

SEQ ID NO: 568609 - DNA, 481 bp, Homo sapiens; identical to SEQ ID NO: 535993
  misc_feature: HIJSMM301BJZHQ.21.25.C03.1.454.light.4.raw

SEQ ID NO: 568610 - DNA, 518 bp, Homo sapiens; identical to SEQ ID NO: 562518
  misc_feature: HIJSMM301E0W3Z.48.17.B06.1.454.light.4.raw

SEQ ID NO: 568611 - DNA, 500 bp, Homo sapiens
  misc_feature: HIJSMM301DWI6J.48.29.C07.1.454.light.4.raw
agtatacatacacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaagggaccgaaggtaggaaatacaaacgaactagtggctgcacca

SEQ ID NO: 568612 - DNA, 487 bp, Homo sapiens
  misc_feature: HIJSMM301CNXDW.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaactggacatcaaacgaactgtggctgcaccatctgtt

SEQ ID NO: 568613 - DNA, 504 bp, Homo sapiens
  misc_feature: HIJSMM301A98BU.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgcagttggttcctctttcaagatattcggcggagggaccaggctgaccgtcctgagtcagcccaaggctgccccccg

SEQ ID NO: 568614 - DNA, 488 bp, Homo sapiens; identical to SEQ ID NO: 535990
  misc_feature: HIJSMM301BYD9D.11.28.C06.1.454.light.4.raw

SEQ ID NO: 568615 - DNA, 493 bp, Homo sapiens; identical to SEQ ID NO: 544335
  misc_feature: HIJSMM301DHY4P.5.57.F02.1.454.light.4.raw

SEQ ID NO: 568616 - DNA, 498 bp, Homo sapiens
  misc_feature: HIJSMM301DKDKU.41.14.B03.1.454.light.4.raw
tctatactatcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 568617 - DNA, 493 bp, Homo sapiens; identical to SEQ ID NO: 537281
  misc_feature: HIJSMM301C9VAZ.9.1.A01.1.454.light.4.raw

SEQ ID NO: 568618 - DNA, 501 bp, Homo sapiens
  misc_feature: HIJSMM301BTM68.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagttttcagtagtcccccggacgttcggtccaagggaccaacggtggacgatcaaacgaacctagtggctggcaccactctgtcttt

SEQ ID NO: 568619 - DNA, 486 bp, Homo sapiens
  misc_feature: HIJSMM301D9YGC.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggaggggaccaagttgaccgtcctaggtcagcccaaggctcg

SEQ ID NO: 568620 - DNA, 505 bp, Homo sapiens; identical to SEQ ID NO: 542298
  misc_feature: HIJSMM301EPNCR.14.3.A03.1.454.light.4.raw

SEQ ID NO: 568621 - DNA, 508 bp, Homo sapiens; identical to SEQ ID NO: 552404
  misc_feature: HIJSMM301EUL3Y.16.46.E02.1.454.light.4.raw

SEQ ID NO: 568622 - DNA, 498 bp, Homo sapiens; identical to SEQ ID NO: 565848
  misc_feature: HIJSMM301DPK3A.22.86.H09.1.454.light.4.raw

SEQ ID NO: 568623 - DNA, 494 bp, Homo sapiens
  misc_feature: HIJSMM301AO62Q.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaacctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 568624 - DNA, 491 bp, Homo sapiens; identical to SEQ ID NO: 538021
  misc_feature: HIJSMM301CA86A.3.72.G06.1.454.light.4.raw

SEQ ID NO: 568625 - DNA, 484 bp, Homo sapiens; identical to SEQ ID NO: 535400
  misc_feature: HIJSMM301CWUPQ.46.26.C04.1.454.light.4.raw

SEQ ID NO: 568626 - DNA, 507 bp, Homo sapiens
  misc_feature: HIJSMM301DMB6D.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 568627 - DNA, 513 bp, Homo sapiens; identical to SEQ ID NO: 542133
  misc_feature: HIJSMM301CSQ72.14.78.H01.1.454.light.4.raw

SEQ ID NO: 568628 - DNA, 440 bp, Homo sapiens
  misc_feature: HIJSMM301D2JK1.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgtcccgccctcctcactagtataga

SEQ ID NO: 568629 - DNA, 490 bp, Homo sapiens; identical to SEQ ID NO: 535234
  misc_feature: HIJSMM301AWGT6.17.21.B10.1.454.light.4.raw

SEQ ID NO: 568630 - DNA, 488 bp, Homo sapiens
  misc_feature: HIJSMM301BTYM6.46.35.D02.1.454.light.4.raw
actagcagtacacgaccggtgctcgatttagcacacgatagttgggtttcgggggacgctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 568631 - DNA, 515 bp, Homo sapiens; identical to SEQ ID NO: 557280
  misc_feature: HIJSMM301C2Z2E.15.86.H09.1.454.light.4.raw

SEQ ID NO: 568632 - DNA, 487 bp, Homo sapiens; identical to SEQ ID NO: 536536
  misc_feature: HIJSMM301BBZ6H.26.45.E01.1.454.light.4.raw

SEQ ID NO: 568633 - DNA, 513 bp, Homo sapiens
  misc_feature: HIJSMM301CEM8I.8.71.G05.1.454.light.4.raw
ctcgcgtgtccacgaccggtgctcgatttagtgtcgtcgcaagagagaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgag

SEQ ID NO: 568634 - DNA, 490 bp, Homo sapiens; identical to SEQ ID NO: 542534
  misc_feature: HIJSMM301A4IZV.16.68.G02.1.454.light.4.raw

SEQ ID NO: 568635 - DNA, 492 bp, Homo sapiens; identical to SEQ ID NO: 535864
  misc_feature: HIJSMM301CWY6H.3.71.G05.1.454.light.4.raw

SEQ ID NO: 568636 - DNA, 507 bp, Homo sapiens; identical to SEQ ID NO: 535641
  misc_feature: HIJSMM301DFOYM.10.88.H11.1.454.light.4.raw

SEQ ID NO: 568637 - DNA, 444 bp, Homo sapiens; identical to SEQ ID NO: 536484
  misc_feature: HIJSMM301DR3WQ.8.11.A11.1.454.light.4.raw

SEQ ID NO: 568638 - DNA, 484 bp, Homo sapiens; identical to SEQ ID NO: 535400
  misc_feature: HIJSMM301B62LL.46.26.C04.1.454.light.4.raw

SEQ ID NO: 568639 - DNA, 499 bp, Homo sapiens; identical to SEQ ID NO: 538774
  misc_feature: HIJSMM301ASHVQ.26.26.C04.1.454.light.4.raw

SEQ ID NO: 568640 - DNA, 416 bp, Homo sapiens; identical to SEQ ID NO: 536892
  misc_feature: HIJSMM301CRQEB.16.46.E02.1.454.light.4.raw

SEQ ID NO: 568641 - DNA, 487 bp, Homo sapiens; identical to SEQ ID NO: 548963
  misc_feature: HIJSMM301DONR1.26.23.C01.1.454.light.4.raw

SEQ ID NO: 568642 - DNA, 447 bp, Homo sapiens; identical to SEQ ID NO: 535201
  misc_feature: HIJSMM301B0LCU.18.9.A09.1.454.light.4.raw

SEQ ID NO: 568643 - DNA, 489 bp, Homo sapiens
  misc_feature: HIJSMM301EWV0M.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggagatacaaacgaa

SEQ ID NO: 568644 - DNA, 461 bp, Homo sapiens
  misc_feature: HIJSMM301AXW6C.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtcgatcctagttgggtgttcggcggagggaccaggctgaccgtcctaggtcagcccaaggctgccccctcggtcactctgttcccaccctcctcacgcgtatgt

SEQ ID NO: 568645 - DNA, 496 bp, Homo sapiens; identical to SEQ ID NO: 537925
  misc_feature: HIJSMM301ADKMX.22.14.B03.1.454.light.4.raw

SEQ ID NO: 568646 - DNA, 482 bp, Homo sapiens; identical to SEQ ID NO: 551063
  misc_feature: HIJSMM301DJT9X.21.25.C03.1.454.light.4.raw

SEQ ID NO: 568647 - DNA, 507 bp, Homo sapiens; identical to SEQ ID NO: 567800
  misc_feature: HIJSMM301CXEUT.9.12.B01.1.454.light.4.raw

SEQ ID NO: 568648 - DNA, 508 bp, Homo sapiens; identical to SEQ ID NO: 542778
  misc_feature: HIJSMM301ATQXT.5.24.C02.1.454.light.4.raw

SEQ ID NO: 568649 - DNA, 484 bp, Homo sapiens; identical to SEQ ID NO: 537086
  misc_feature: HIJSMM301BPATG.5.39.D06.1.454.light.4.raw

SEQ ID NO: 568650 - DNA, 505 bp, Homo sapiens
  misc_feature: HIJSMM301DAQCI.52.28.C06.1.454.light.4.raw
cgcagtacgacacgaccggtgctcgatttagagctcacgtattgggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcctgcatagtaatggaaacaactatttgaattggttcctgcagaagccagggcagtctccacaactcctaatctattggggttctattcgggcctccggggtccctgacaggttcagtggcagtgggtcaggcacagattttacactgagaatcaccagagtggaggctgaagattttggggtttatttctgcatgcaaagtctacacacaccctggacgttcggccaagggaccaaggtggaaatcaaacgaactgtggctgcaccatctgtt

SEQ ID NO: 568651 - DNA, 417 bp, Homo sapiens
  misc_feature: HIJSMM301D1HTJ.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 568652 - DNA, 478 bp, Homo sapiens; identical to SEQ ID NO: 535129
  misc_feature: HIJSMM301C9NAG.11.11.A11.1.454.light.4.raw

SEQ ID NO: 568653 - DNA, 506 bp, Homo sapiens
  misc_feature: HIJSMM301D11RS.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccacttcggccctgggaccaaagtggatatcaaacgaactgtggctgcaccatctgtcttcta

SEQ ID NO: 568654 - DNA, 512 bp, Homo sapiens
  misc_feature: HIJSMM301BK0YK.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagtttggttcctctttcaagatagttcggcggagggaccaggctcggaccgtcctgagtcacgcccaaggcctcgcccccccg

SEQ ID NO: 568655 - DNA, 476 bp, Homo sapiens
  misc_feature: HIJSMM301EV7T8.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcgcacggagacgactacggtaggagtaaacgtaaaccgagttggcg

SEQ ID NO: 568656 - DNA, 504 bp, Homo sapiens
  misc_feature: HIJSMM301D0J2Z.48.73.G07.1.454.light.4.raw
agtatacatacacgaccggtgctcgatttagctctacgctcagggcacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgacgtaggagattaaacgaa

SEQ ID NO: 568657 - DNA, 476 bp, Homo sapiens; identical to SEQ ID NO: 537812
  misc_feature: HIJSMM301D5J1B.3.82.H05.1.454.light.4.raw

SEQ ID NO: 568658 - DNA, 448 bp, Homo sapiens; identical to SEQ ID NO: 540364
  misc_feature: HIJSMM301ALX1J.18.9.A09.1.454.light.4.raw

SEQ ID NO: 568659 - DNA, 500 bp, Homo sapiens; identical to SEQ ID NO: 535310
  misc_feature: HIJSMM301EWEPG.47.66.F11.1.454.light.4.raw

SEQ ID NO: 568660 - DNA, 505 bp, Homo sapiens; identical to SEQ ID NO: 535987
  misc_feature: HIJSMM301CA4VL.18.37.D04.1.454.light.4.raw

SEQ ID NO: 568661 - DNA, 454 bp, Homo sapiens
  misc_feature: HIJSMM301AHWJD.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaagctcgcccctcggtcactctcgttcccaccctcctccacgagagta

SEQ ID NO: 568662 - DNA, 492 bp, Homo sapiens; identical to SEQ ID NO: 540272
  misc_feature: HIJSMM301EY7F5.41.23.C01.1.454.light.4.raw

SEQ ID NO: 568663 - DNA, 354 bp, Homo sapiens; identical to SEQ ID NO: 540485
  misc_feature: HIJSMM301BWONK.40.9.A09.1.454.light.4.raw

SEQ ID NO: 568664 - DNA, 486 bp, Homo sapiens; identical to SEQ ID NO: 535917
  misc_feature: HIJSMM301AQZSF.3.10.A10.1.454.light.4.raw

SEQ ID NO: 568665 - DNA, 444 bp, Homo sapiens; identical to SEQ ID NO: 535192
  misc_feature: HIJSMM301E2JL5.5.9.A09.1.454.light.4.raw

SEQ ID NO: 568666 - DNA, 520 bp, Homo sapiens
  misc_feature: HIJSMM301D8HIX.27.23.C01.1.454.light.4.raw
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcgtcactctgttcccnccct

SEQ ID NO: 568667 - DNA, 496 bp, Homo sapiens
  misc_feature: HIJSMM301AP2RC.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggaggatcaaacgaactagtggctgcaccatctgtctt

SEQ ID NO: 568668 - DNA, 501 bp, Homo sapiens
  misc_feature: HIJSMM301D2A7P.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagattcttcttaccctcggacgttcggtccacggggaccgaccggtgggagtgttcaacgtcggaaacctgtggcgtgcgaccactcttcg

SEQ ID NO: 568669 - DNA, 481 bp, Homo sapiens; identical to SEQ ID NO: 535993
  misc_feature: HIJSMM301C5JPH.21.25.C03.1.454.light.4.raw

SEQ ID NO: 568670 - DNA, 475 bp, Homo sapiens; identical to SEQ ID NO: 537714
  misc_feature: HIJSMM301ELMCA.7.81.H04.1.454.light.4.raw

SEQ ID NO: 568671 - DNA, 473 bp, Homo sapiens
  misc_feature: HIJSMM301EKW2V.49.4.A04.1.454.light.4.raw
agtcgagagacacgaccggtgctcgatttagagtagtgatcaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagacaaaaaccagggacagcccctaaactcctgatcctcgatgcatccactttggagacaggggtcccatcaaggttcagtggaagtggctctgggacagtatttttactttcaccatcagcaggctgcagcctgaagatattgcaacatattactgtcaacagtatgatcgcctcccgctcactttcggcgggggaccaaggtggagatcaagcgaactgtggctgcacca

SEQ ID NO: 568672 - DNA, 478 bp, Homo sapiens
  misc_feature: HIJSMM301A15S7.52.22.B11.1.454.light.4.raw
cgcagtacgacacgaccggtgctcgatttagacgacagctcaggggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcaagcagagtggaggctgaggatgttggggtttattactgcatgcaagttctacaaaatcctcgcacttttggccaggggaccaagctggagatcaaacgaa

SEQ ID NO: 568673 - DNA, 494 bp, Homo sapiens
  misc_feature: HIJSMM301ESL7P.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctccgtacacttttggccagggaccaagctggagatcaaacgaactgtggctgcaccatctgtcttc

SEQ ID NO: 568674 - DNA, 507 bp, Homo sapiens; identical to SEQ ID NO: 564521
  misc_feature: HIJSMM301BM0PQ.21.87.H10.1.454.light.4.raw

SEQ ID NO: 568675 - DNA, 475 bp, Homo sapiens
  misc_feature: HIJSMM301AHPYW.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaacggtaggagatcaaacgaa

SEQ ID NO: 568676 - DNA, 501 bp, Homo sapiens
  misc_feature: HIJSMM301D35XD.49.35.D02.1.454.light.4.raw
agtcgagagacacgaccggtgctcgatttagcacacgatagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccatctgtcttcatcttcccg

SEQ ID NO: 568677 - DNA, 486 bp, Homo sapiens; identical to SEQ ID NO: 547345
  misc_feature: HIJSMM301C3TLJ.47.78.H01.1.454.light.4.raw

SEQ ID NO: 568678 - DNA, 517 bp, Homo sapiens; identical to SEQ ID NO: 541955
  misc_feature: HIJSMM301C6MJ0.22.30.C08.1.454.light.4.raw

SEQ ID NO: 568679 - DNA, 503 bp, Homo sapiens; identical to SEQ ID NO: 545754
  misc_feature: HIJSMM301B4WF3.19.78.H01.1.454.light.4.raw

SEQ ID NO: 568680 - DNA, 486 bp, Homo sapiens; identical to SEQ ID NO: 539938
  misc_feature: HIJSMM301BTNHH.15.1.A01.1.454.light.4.raw

SEQ ID NO: 568681 - DNA, 486 bp, Homo sapiens
  misc_feature: HIJSMM301EGSZP.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaaagtggagatcaaacgaa

SEQ ID NO: 568682 - DNA, 499 bp, Homo sapiens
  misc_feature: HIJSMM301A1WU7.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtggaaagtcaaacgaactagtggctgcacc

SEQ ID NO: 568683 - DNA, 463 bp, Homo sapiens; identical to SEQ ID NO: 553170
  misc_feature: HIJSMM301BJH9S.17.28.C06.1.454.light.4.raw

SEQ ID NO: 568684 - DNA, 477 bp, Homo sapiens
  misc_feature: HIJSMM301C0SUV.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcgggcc

SEQ ID NO: 568685 - DNA, 494 bp, Homo sapiens; identical to SEQ ID NO: 534992
  misc_feature: HIJSMM301BTR1V.9.1.A01.1.454.light.4.raw

SEQ ID NO: 568686 - DNA, 447 bp, Homo sapiens; identical to SEQ ID NO: 535201
  misc_feature: HIJSMM301BMA5K.18.9.A09.1.454.light.4.raw

SEQ ID NO: 568687 - DNA, 494 bp, Homo sapiens; identical to SEQ ID NO: 567179
  misc_feature: HIJSMM301D00OF.52.86.H09.1.454.light.4.raw

SEQ ID NO: 568688 - DNA, 476 bp, Homo sapiens; identical to SEQ ID NO: 537368
  misc_feature: HIJSMM301AR2IK.7.83.H06.1.454.light.4.raw

SEQ ID NO: 568689 - DNA, 444 bp, Homo sapiens; identical to SEQ ID NO: 535192
  misc_feature: HIJSMM301C64QQ.5.9.A09.1.454.light.4.raw

SEQ ID NO: 568690 - DNA, 499 bp, Homo sapiens; identical to SEQ ID NO: 550763
  misc_feature: HIJSMM301BDU9S.19.78.H01.1.454.light.4.raw

SEQ ID NO: 568691 - DNA, 510 bp, Homo sapiens
  misc_feature: HIJSMM301B0YK3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccagccaccctgtctttgtctccaggggaaagagccaccctctcctgcagggccagtcagagtgttggcgcctacgtagcctggtaccaacagaaacctggccaggctcctaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcatcttcccgccta

SEQ ID NO: 568692 - DNA, 504 bp, Homo sapiens
  misc_feature: HIJSMM301B6CU2.2.35.D02.1.454.light.4.raw
acgctcgacacacgaccggtgctcgatttagcacacgatagttgggtttgggggtctcaggaggtcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaaggctgaccgtcctgggtcagcccaaggctgccccctcggtca

SEQ ID NO: 568693 - DNA, 490 bp, Homo sapiens; identical to SEQ ID NO: 541244
  misc_feature: HIJSMM301B08TQ.41.44.D11.1.454.light.4.raw

SEQ ID NO: 568694 - DNA, 504 bp, Homo sapiens; identical to SEQ ID NO: 553842
  misc_feature: HIJSMM301EAUX8.16.9.A09.1.454.light.4.raw

SEQ ID NO: 568695 - DNA, 520 bp, Homo sapiens; identical to SEQ ID NO: 543376
  misc_feature: HIJSMM301EP0PG.10.86.H09.1.454.light.4.raw

SEQ ID NO: 568696 - DNA, 494 bp, Homo sapiens; identical to SEQ ID NO: 537272
  misc_feature: HIJSMM301CB2WC.47.78.H01.1.454.light.4.raw

SEQ ID NO: 568697 - DNA, 512 bp, Homo sapiens
  misc_feature: HIJSMM301AJ5MP.48.15.B04.1.454.light.4.raw
agtatacatacacgaccggtgctcgatttagacagtatatatccggcgggcacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagacccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaa

SEQ ID NO: 568698 - DNA, 498 bp, Homo sapiens
  misc_feature: HIJSMM301C7LH6.51.59.F04.1.454.light.4.raw
cgatcgtatacacgaccggtgctcgatttagtacacacacttagggattgggggtgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 568699 - DNA, 505 bp, Homo sapiens; identical to SEQ ID NO: 535503
  misc_feature: HIJSMM301BP6D6.8.28.C06.1.454.light.4.raw

SEQ ID NO: 568700 - DNA, 446 bp, Homo sapiens; identical to SEQ ID NO: 536106
  misc_feature: HIJSMM301EWA5S.18.9.A09.1.454.light.4.raw

SEQ ID NO: 568701 - DNA, 513 bp, Homo sapiens; identical to SEQ ID NO: 535244
  misc_feature: HIJSMM301CT1BA.17.33.C11.1.454.light.4.raw

SEQ ID NO: 568702 - DNA, 520 bp, Homo sapiens; identical to SEQ ID NO: 537173
  misc_feature: HIJSMM301EMXL6.27.23.C01.1.454.light.4.raw

SEQ ID NO: 568703 - DNA, 494 bp, Homo sapiens
  misc_feature: HIJSMM301APVJK.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggggtgattattactgcagctcatatagaagtggcagcactctcgtattcggcggtgggaccaagctgaccgtctaggtcagcccaagg

SEQ ID NO: 568704 - DNA, 479 bp, Homo sapiens
  misc_feature: HIJSMM301CYITZ.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgcttcaccttcggcgggggaccaaggtggagatcaaacgaactgtggctgcacc

SEQ ID NO: 568705 - DNA, 518 bp, Homo sapiens
  misc_feature: HIJSMM301CR3X8.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccagggtcgggacccctgcgcgattctctgcctccatctcggggaacgcggccaccctgaccatcagcaaagcccaagccggtgatgaggctgacttatttttgtcaggtgtgggacagcagcatttatgtcttcggacctgggaccaaggtcaccgtcctaggtcagcccaaggcccaaccccactgtcactctcgttcccaccctcctcga

SEQ ID NO: 568706 - DNA, 499 bp, Homo sapiens
  misc_feature: HIJSMM301BBTV4.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagccaaggctgccccctcggtcactctgttccaccct

SEQ ID NO: 568707 - DNA, 474 bp, Homo sapiens; identical to SEQ ID NO: 543944
  misc_feature: HIJSMM301BI6MI.5.70.G04.1.454.light.4.raw

SEQ ID NO: 568708 - DNA, 520 bp, Homo sapiens; identical to SEQ ID NO: 567791
  misc_feature: HIJSMM301BDM6G.27.23.C01.1.454.light.4.raw

SEQ ID NO: 568709 - DNA, 501 bp, Homo sapiens; identical to SEQ ID NO: 535746
  misc_feature: HIJSMM301BNJX4.18.11.A11.1.454.light.4.raw

SEQ ID NO: 568710 - DNA, 501 bp, Homo sapiens; identical to SEQ ID NO: 535746
  misc_feature: HIJSMM301A4DS8.18.11.A11.1.454.light.4.raw

SEQ ID NO: 568711 - DNA, 436 bp, Homo sapiens
  misc_feature: HIJSMM301ES9X7.51.41.D08.1.454.light.4.raw
cgatcgtatacacgaccggtgctcgatttagtcacgcgagaaagggaaagggactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtcttcatcttcccgccatctgatcgtagcact

SEQ ID NO: 568712 - DNA, 506 bp, Homo sapiens
  misc_feature: HIJSMM301DEX9N.47.85.H08.1.454.light.4.raw
  modified_base (476)..(476): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctggctcgagtctgaggacgaggctgattacttctgttgctcttggcaactactgtcgtttgggtgttcggcggagggaccagttgaccgtcctaggtcngccaaggctgccccctcggtcactctcgtt

SEQ ID NO: 568713 - DNA, 497 bp, Homo sapiens; identical to SEQ ID NO: 546781
  misc_feature: HIJSMM301BV14S.43.28.C06.1.454.light.4.raw

SEQ ID NO: 568714 - DNA, 466 bp, Homo sapiens; identical to SEQ ID NO: 535366
  misc_feature: HIJSMM301A8JD8.13.4.A04.1.454.light.4.raw

SEQ ID NO: 568715 - DNA, 494 bp, Homo sapiens
  misc_feature: HIJSMM301CJ1Z0.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccgaagggaccgagggtggaaagtacaagcgaactgtggcgtgcaccatctgtctt

SEQ ID NO: 568716 - DNA, 502 bp, Homo sapiens; identical to SEQ ID NO: 540122
  misc_feature: HIJSMM301BDUQ2.16.9.A09.1.454.light.4.raw

SEQ ID NO: 568717 - DNA, 489 bp, Homo sapiens
  misc_feature: HIJSMM301BVDHM.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgcccctcggtcactc

SEQ ID NO: 568718 - DNA, 503 bp, Homo sapiens
  misc_feature: HIJSMM301CGVM4.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctcggtcacttcg

SEQ ID NO: 568719 - DNA, 492 bp, Homo sapiens
  misc_feature: HIJSMM301BZAPA.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgatttgcaacttattactgccaacagtatcatcatcattgtaatttcggtggagggaccaaaggtggaggtcaaacgaaactgtggctgcaccatctgtcttcatt

SEQ ID NO: 568720 - DNA, 489 bp, Homo sapiens; identical to SEQ ID NO: 565650
  misc_feature: HIJSMM301CM1ER.14.55.E11.1.454.light.4.raw

SEQ ID NO: 568721 - DNA, 495 bp, Homo sapiens
  misc_feature: HIJSMM301ET8KU.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactagtggctgcaccatctgtcttcatt

SEQ ID NO: 568722 - DNA, 512 bp, Homo sapiens
  misc_feature: HIJSMM301CYCWE.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgttccg

SEQ ID NO: 568723 - DNA, 517 bp, Homo sapiens; identical to SEQ ID NO: 536980
  misc_feature: HIJSMM301AQYXI.5.27.C05.1.454.light.4.raw

SEQ ID NO: 568724 - DNA, 490 bp, Homo sapiens; identical to SEQ ID NO: 565304
  misc_feature: HIJSMM301ES5OS.21.65.F10.1.454.light.4.raw

SEQ ID NO: 568725 - DNA, 495 bp, Homo sapiens
  misc_feature: HIJSMM301BCLMH.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcctcacgtcg

SEQ ID NO: 568726 - DNA, 478 bp, Homo sapiens; identical to SEQ ID NO: 535129
  misc_feature: HIJSMM301B9XXW.11.11.A11.1.454.light.4.raw

SEQ ID NO: 568727 - DNA, 496 bp, Homo sapiens
  misc_feature: HIJSMM301DMZPR.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccatctgtctt

SEQ ID NO: 568728 - DNA, 498 bp, Homo sapiens; identical to SEQ ID NO: 544837
  misc_feature: HIJSMM301BO8C4.11.71.G05.1.454.light.4.raw

SEQ ID NO: 568729 - DNA, 507 bp, Homo sapiens; identical to SEQ ID NO: 556531
  misc_feature: HIJSMM301DBAH6.15.5.A05.1.454.light.4.raw

SEQ ID NO: 568730 - DNA, 519 bp, Homo sapiens; identical to SEQ ID NO: 562105
  misc_feature: HIJSMM301COMPZ.27.23.C01.1.454.light.4.raw

SEQ ID NO: 568731 - DNA, 462 bp, Homo sapiens
  misc_feature: HIJSMM301DLO5O.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgttggttttcggcggagggaccaagctgaccgtcctaggtcagccaaggctcgccccctcggtcactctcgttcccaccttcctcgtatctctcg

SEQ ID NO: 568732 - DNA, 410 bp, Homo sapiens
  misc_feature: HIJSMM301A3DRO.10.86.H09.1.454.light.4.raw
catagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 568733 - DNA, 480 bp, Homo sapiens
  misc_feature: HIJSMM301AXGCG.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccacgggaccgaaacgtggatgtcaaccgaactagtggctgcacca

SEQ ID NO: 568734 - DNA, 508 bp, Homo sapiens
  misc_feature: HIJSMM301BEXR4.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctaggttggtgttcggcggagggaccaggctgaccgtcctaggtcagcccaaggct

SEQ ID NO: 568735 - DNA, 455 bp, Homo sapiens
  misc_feature: HIJSMM301CEPUO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgccttttaagcagcgcaaggctgccccctcggtcactctgttcccacctcctccaccgagagta

SEQ ID NO: 568736 - DNA, 505 bp, Homo sapiens; identical to SEQ ID NO: 535503
  misc_feature: HIJSMM301D053B.8.28.C06.1.454.light.4.raw

SEQ ID NO: 568737 - DNA, 505 bp, Homo sapiens; identical to SEQ ID NO: 542781
  misc_feature: HIJSMM301EL1B4.4.57.F02.1.454.light.4.raw

SEQ ID NO: 568738 - DNA, 486 bp, Homo sapiens; identical to SEQ ID NO: 535043
  misc_feature: HIJSMM301DQI1L.46.35.D02.1.454.light.4.raw

SEQ ID NO: 568739 - DNA, 521 bp, Homo sapiens
  misc_feature: HIJSMM301C6JOU.27.23.C01.1.454.light.4.raw
  modified_base (501)..(501): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccncggtcactctgtcccgccct

SEQ ID NO: 568740 - DNA, 493 bp, Homo sapiens; identical to SEQ ID NO: 535745
  misc_feature: HIJSMM301BCF0X.47.78.H01.1.454.light.4.raw

SEQ ID NO: 568741 - DNA, 485 bp, Homo sapiens; identical to SEQ ID NO: 536040
  misc_feature: HIJSMM301DX710.15.1.A01.1.454.light.4.raw

SEQ ID NO: 568742 - DNA, 481 bp, Homo sapiens; identical to SEQ ID NO: 545581
  misc_feature: HIJSMM301D3CUS.48.19.B08.1.454.light.4.raw

SEQ ID NO: 568743 - DNA, 493 bp, Homo sapiens; identical to SEQ ID NO: 535084
  misc_feature: HIJSMM301CVE8Y.47.64.F09.1.454.light.4.raw

SEQ ID NO: 568744 - DNA, 486 bp, Homo sapiens; identical to SEQ ID NO: 535043
  misc_feature: HIJSMM301DSSLC.46.35.D02.1.454.light.4.raw

SEQ ID NO: 568745 - DNA, 496 bp, Homo sapiens
  misc_feature: HIJSMM301EPZF3.51.6.A06.1.454.light.4.raw
cgatcgtatacacgaccggtgctcgatttagatctactgacaggggggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctgttccccg

SEQ ID NO: 568746 - DNA, 483 bp, Homo sapiens; identical to SEQ ID NO: 535413
  misc_feature: HIJSMM301C5E8S.26.78.H01.1.454.light.4.raw

SEQ ID NO: 568747 - DNA, 495 bp, Homo sapiens; identical to SEQ ID NO: 539114
  misc_feature: HIJSMM301BSTGN.26.72.G06.1.454.light.4.raw

SEQ ID NO: 568748 - DNA, 486 bp, Homo sapiens
  misc_feature: HIJSMM301CR5KU.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggtattttgctaacttattactgccagcagtataatgattaccctatcaccttcggccggggacacggctggaaactaaacgaactgtggctgcacc

SEQ ID NO: 568749 - DNA, 486 bp, Homo sapiens; identical to SEQ ID NO: 535043
  misc_feature: HIJSMM301AM386.46.35.D02.1.454.light.4.raw

SEQ ID NO: 568750 - DNA, 520 bp, Homo sapiens
  misc_feature: HIJSMM301EKO19.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacgactgaccgtcctaggtcagcccgaaggctcgccccctccggtcactctcgtt

SEQ ID NO: 568751 - DNA, 515 bp, Homo sapiens; identical to SEQ ID NO: 538805
  misc_feature: HIJSMM301AW4N0.14.19.B08.1.454.light.4.raw

SEQ ID NO: 568752 - DNA, 501 bp, Homo sapiens; identical to SEQ ID NO: 535746
  misc_feature: HIJSMM301A5GB7.18.11.A11.1.454.light.4.raw

SEQ ID NO: 568753 - DNA, 444 bp, Homo sapiens; identical to SEQ ID NO: 539971
  misc_feature: HIJSMM301B5LHF.8.73.G07.1.454.light.4.raw
  modified_base (426)..(426): a, c, t, g, unknown or other

SEQ ID NO: 568754 - DNA, 516 bp, Homo sapiens
  misc_feature: HIJSMM301BGV80.12.71.G05.1.454.light.4.raw
atacgacgtacacgaccggtgctcgatttagtgtcgtcgcaagagagagggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacct

SEQ ID NO: 568755 - DNA, 490 bp, Homo sapiens; identical to SEQ ID NO: 543909
  misc_feature: HIJSMM301EK7MQ.14.55.E11.1.454.light.4.raw

SEQ ID NO: 568756 - DNA, 513 bp, Homo sapiens
  misc_feature: HIJSMM301A7NGU.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggccaaccccactgtcactctgttccca

SEQ ID NO: 568757 - DNA, 505 bp, Homo sapiens; identical to SEQ ID NO: 537876
  misc_feature: HIJSMM301DSSLQ.5.68.G02.1.454.light.4.raw

SEQ ID NO: 568758 - DNA, 507 bp, Homo sapiens; identical to SEQ ID NO: 559315
  misc_feature: HIJSMM301AH1ME.47.55.E11.1.454.light.4.raw

SEQ ID NO: 568759 - DNA, 469 bp, Homo sapiens; identical to SEQ ID NO: 536091
  misc_feature: HIJSMM301COW8Z.3.82.H05.1.454.light.4.raw

SEQ ID NO: 568760 - DNA, 499 bp, Homo sapiens; identical to SEQ ID NO: 537739
  misc_feature: HIJSMM301BAHNT.12.86.H09.1.454.light.4.raw

SEQ ID NO: 568761 - DNA, 485 bp, Homo sapiens; identical to SEQ ID NO: 538533
  misc_feature: HIJSMM301EJGM5.47.78.H01.1.454.light.4.raw

SEQ ID NO: 568762 - DNA, 478 bp, Homo sapiens
  misc_feature: HIJSMM301CNREG.5.12.B01.1.454.light.4.raw
  modified_base (461)..(461): a, c, t, g, unknown or other
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagttaatgaagacttcttgtgattttcggacggngggaccaagctgaccgt

SEQ ID NO: 568763 - DNA, 514 bp, Homo sapiens; identical to SEQ ID NO: 560276
  misc_feature: HIJSMM301BYQIN.15.86.H09.1.454.light.4.raw

SEQ ID NO: 568764 - DNA, 454 bp, Homo sapiens
  misc_feature: HIJSMM301B65ER.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgacgagta

SEQ ID NO: 568765 - DNA, 479 bp, Homo sapiens; identical to SEQ ID NO: 535665
  misc_feature: HIJSMM301AY5EX.12.10.A10.1.454.light.4.raw

SEQ ID NO: 568766 - DNA, 490 bp, Homo sapiens
  misc_feature: HIJSMM301A25H4.21.25.C03.1.454.light.4.raw
tcgtcgctcgcacgaccggtgctcgattttagtagtgtagatttgggtttgggggctgttccgtggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccagggcccatgctggagattgtcctgagtgcttgcctcttgtgcccacagctgaagcagagcctccaaactcctcatctatggtaacagcaaatcggccctcaggggtccctgaccgattctctggctccaagtctggcacctcagcctcctggtcatcgctgggctccaggctgacgatgaaggctgattattattcgccagtcctatgacaacaccctgccgtggttttggctgttcggtcggcgggacc

SEQ ID NO: 568767 - DNA, 496 bp, Homo sapiens; identical to SEQ ID NO: 560353
  misc_feature: HIJSMM301ETP4O.43.16.B05.1.454.light.4.raw

SEQ ID NO: 568768 - DNA, 492 bp, Homo sapiens
  misc_feature: HIJSMM301AVP5O.51.62.F07.1.454.light.4.raw
cgatcgtatacacgaccggtgctcgatttagtagtcgcataaagggaaagggggacgaggagtcagtcccaacccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcacc

SEQ ID NO: 568769 - DNA, 444 bp, Homo sapiens; identical to SEQ ID NO: 535192
  misc_feature: HIJSMM301BS2IE.5.9.A09.1.454.light.4.raw

SEQ ID NO: 568770 - DNA, 497 bp, Homo sapiens
  misc_feature: HIJSMM301AYOT2.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcagggggagtctgggacagatttcactctcaccatcagcagcctgcagcctgaagattttgcaacttactattgtcaacaggctaacagtttcccttttaacttcttcggtccaagggaacgacgactggaggattaaacgaaactagtggcgtgcacca

SEQ ID NO: 568771 - DNA, 502 bp, Homo sapiens
  misc_feature: HIJSMM301A3VU2.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactatactgcagctcatttgcaggcagccgtatactcttcggcggagggaccaagctgaccgtcctaggtcagcccaaggctgccccctcggtca

SEQ ID NO: 568772 - DNA, 488 bp, Homo sapiens; identical to SEQ ID NO: 539612
  misc_feature: HIJSMM301B2MK2.3.55.E11.1.454.light.4.raw

SEQ ID NO: 568773 - DNA, 505 bp, Homo sapiens; identical to SEQ ID NO: 535503
  misc_feature: HIJSMM301BF2H5.8.28.C06.1.454.light.4.raw

SEQ ID NO: 568774 - DNA, 504 bp, Homo sapiens; identical to SEQ ID NO: 557936
  misc_feature: HIJSMM301CK4LE.19.78.H01.1.454.light.4.raw

SEQ ID NO: 568775 - DNA, 499 bp, Homo sapiens
  misc_feature: HIJSMM301DGOR0.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatgtgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttcattccc

SEQ ID NO: 568776 - DNA, 492 bp, Homo sapiens
  misc_feature: HIJSMM301CN0UC.16.68.G02.1.454.light.4.raw
tgtactactccacgaccggtgctcgatttagtcgatagtgaagggaaagggggagtcagacccagtcaggacacagcatggacatgagggtccccgcttcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 568777 - DNA, 504 bp, Homo sapiens; identical to SEQ ID NO: 537401
  misc_feature: HIJSMM301AM1EI.51.23.C01.1.454.light.4.raw

SEQ ID NO: 568778 - DNA, 486 bp, Homo sapiens; identical to SEQ ID NO: 539294
  misc_feature: HIJSMM301DHNHS.12.33.C11.1.454.light.4.raw

SEQ ID NO: 568779 - DNA, 501 bp, Homo sapiens; identical to SEQ ID NO: 535746
  misc_feature: HIJSMM301EFOY0.18.11.A11.1.454.light.4.raw

SEQ ID NO: 568780 - DNA, 473 bp, Homo sapiens
  misc_feature: HIJSMM301ANAGZ.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaagtataacagtgcccccttcaccttcggccaagggacacgactggagattagaacg

SEQ ID NO: 568781 - DNA, 513 bp, Homo sapiens
  misc_feature: HIJSMM301DDBGH.8.39.D06.1.454.light.4.raw
ctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtgctgcaccatctgtcttcatcttcccgccat

SEQ ID NO: 568782 - DNA, 493 bp, Homo sapiens; identical to SEQ ID NO: 535657
  misc_feature: HIJSMM301ATJKZ.27.78.H01.1.454.light.4.raw

SEQ ID NO: 568783 - DNA, 484 bp, Homo sapiens
  misc_feature: HIJSMM301C7RO5.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggc

SEQ ID NO: 568784 - DNA, 474 bp, Homo sapiens; identical to SEQ ID NO: 544751
  misc_feature: HIJSMM301A3588.3.38.D05.1.454.light.4.raw

SEQ ID NO: 568785 - DNA, 492 bp, Homo sapiens
  misc_feature: HIJSMM301AL1JL.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgcaggacgaagtaggacgatcaagcgaactacgtggcgtgcgaccactctgtt

SEQ ID NO: 568786 - DNA, 501 bp, Homo sapiens; identical to SEQ ID NO: 550407
  misc_feature: HIJSMM301C44JY.4.39.D06.1.454.light.4.raw

SEQ ID NO: 568787 - DNA, 480 bp, Homo sapiens; identical to SEQ ID NO: 535291
  misc_feature: HIJSMM301DAS0V.22.59.F04.1.454.light.4.raw

SEQ ID NO: 568788 - DNA, 473 bp, Homo sapiens; identical to SEQ ID NO: 535262
  misc_feature: HIJSMM301CX3DY.8.67.G01.1.454.light.4.raw

SEQ ID NO: 568789 - DNA, 486 bp, Homo sapiens
  misc_feature: HIJSMM301DKE3B.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaccccctaagctcctgatctatggtgcatccactttggaaagtggggtccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccat

SEQ ID NO: 568790 - DNA, 501 bp, Homo sapiens; identical to SEQ ID NO: 536867
  misc_feature: HIJSMM301BLMFZ.5.86.H09.1.454.light.4.raw

SEQ ID NO: 568791 - DNA, 498 bp, Homo sapiens
  misc_feature: HIJSMM301BCEJM.10.65.F10.1.454.light.4.raw
  modified_base (487)..(487): a, c, t, g, unknown or other
catagtagtgcacgaccggtgctcgatttagctacgctctaagggggagtcagtctcagtcaggacacagcatggacatgagggtccccgctcagctcctggggctcctgctactctggctccgaggtgccagatgtgacatcccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaacccgttactttcggcggaggaccgaaggtggaggatcaaacgaactgtggctgcaccatctgtcttcntcttcccgcca

SEQ ID NO: 568792 - DNA, 470 bp, Homo sapiens
  misc_feature: HIJSMM301C2NAE.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtgg

SEQ ID NO: 568793 - DNA, 499 bp, Homo sapiens; identical to SEQ ID NO: 536578
  misc_feature: HIJSMM301D6YTN.22.27.C05.1.454.light.4.raw

SEQ ID NO: 568794 - DNA, 506 bp, Homo sapiens
  misc_feature: HIJSMM301DOMVV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccaaggtggaaatacaaaacgaactagtggctgcaccatctgtcttcatcttccccg

SEQ ID NO: 568795 - DNA, 491 bp, Homo sapiens; identical to SEQ ID NO: 537135
  misc_feature: HIJSMM301CV350.21.46.E02.1.454.light.4.raw

SEQ ID NO: 568796 - DNA, 506 bp, Homo sapiens
  misc_feature: HIJSMM301CKBLT.22.21.B10.1.454.light.4.raw
acatacgcgtcacgaccggtgctcgatttagtgtcgtcgcaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaacctcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 568797 - DNA, 492 bp, Homo sapiens
  misc_feature: HIJSMM301BQE6B.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtccccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 568798 - DNA, 447 bp, Homo sapiens; identical to SEQ ID NO: 554574
  misc_feature: HIJSMM301C7JBZ.18.9.A09.1.454.light.4.raw

SEQ ID NO: 568799 - DNA, 447 bp, Homo sapiens; identical to SEQ ID NO: 535020
  misc_feature: HIJSMM301A6JK1.18.9.A09.1.454.light.4.raw

SEQ ID NO: 568800 - DNA, 444 bp, Homo sapiens; identical to SEQ ID NO: 534993
  misc_feature: HIJSMM301DKSSC.5.9.A09.1.454.light.4.raw

SEQ ID NO: 568801 - DNA, 493 bp, Homo sapiens
  misc_feature: HIJSMM301A4L63.43.87.H10.1.454.light.4.raw
tgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggcctgccccctcggtcactctgttctcgccctcctcta

SEQ ID NO: 568802 - DNA, 498 bp, Homo sapiens; identical to SEQ ID NO: 540535
  misc_feature: HIJSMM301DFZHI.41.40.D07.1.454.light.4.raw

SEQ ID NO: 568803 - DNA, 494 bp, Homo sapiens; identical to SEQ ID NO: 535680
  misc_feature: HIJSMM301CLTGV.16.78.H01.1.454.light.4.raw

SEQ ID NO: 568804 - DNA, 489 bp, Homo sapiens; identical to SEQ ID NO: 535139
  misc_feature: HIJSMM301DDGAW.14.55.E11.1.454.light.4.raw

SEQ ID NO: 568805 - DNA, 494 bp, Homo sapiens
  misc_feature: HIJSMM301ERCL9.52.38.D05.1.454.light.4.raw
cgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 568806 - DNA, 503 bp, Homo sapiens
  misc_feature: HIJSMM301CR8JK.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaagggtggagatccaacgactgtggctgcaccatctgtcttcatctccccg

SEQ ID NO: 568807 - DNA, 498 bp, Homo sapiens
  misc_feature: HIJSMM301A6QBU.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtctaacgtcagccccaa

SEQ ID NO: 568808 - DNA, 442 bp, Homo sapiens
  misc_feature: HIJSMM301BZFRQ.48.59.F04.1.454.light.4.raw
agtatacatacacgaccggtgctcgatttagtacacacacttagggattgggggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaggctgccccctcggtcactctgttcccgccctcctctatgtatact

SEQ ID NO: 568809 - DNA, 494 bp, Homo sapiens; identical to SEQ ID NO: 534994
  misc_feature: HIJSMM301EGLEH.27.78.H01.1.454.light.4.raw

SEQ ID NO: 568810 - DNA, 520 bp, Homo sapiens
  misc_feature: HIJSMM301AQI88.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggcgttcggtccgaacgggaccgaacggtagggaaagtacaaacgaaacctagtggcgtcgcaccatctgtcgttctatcttccccg

SEQ ID NO: 568811 - DNA, 491 bp, Homo sapiens
  misc_feature: HIJSMM301CGAW7.13.46.E02.1.454.light.4.raw
tcacgtactacacgaccggtgctcgatttagactcatctacagggaaagggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtgg

SEQ ID NO: 568812 - DNA, 454 bp, Homo sapiens; identical to SEQ ID NO: 536846
  misc_feature: HIJSMM301C3ZMN.18.78.H01.1.454.light.4.raw

SEQ ID NO: 568813 - DNA, 490 bp, Homo sapiens; identical to SEQ ID NO: 541567
  misc_feature: HIJSMM301CM2T2.22.65.F10.1.454.light.4.raw

SEQ ID NO: 568814 - DNA, 504 bp, Homo sapiens; identical to SEQ ID NO: 542288
  misc_feature: HIJSMM301EQY5U.8.28.C06.1.454.light.4.raw

SEQ ID NO: 568815 - DNA, 447 bp, Homo sapiens; identical to SEQ ID NO: 535201
  misc_feature: HIJSMM301AGSO6.18.9.A09.1.454.light.4.raw

SEQ ID NO: 568816 - DNA, 504 bp, Homo sapiens
  misc_feature: HIJSMM301BBJSQ.18.86.H09.1.454.light.4.raw
tacgagtatgcacgaccggtgctcgatttagtgctatagacttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccatgt

SEQ ID NO: 568817 - DNA, 512 bp, Homo sapiens
  misc_feature: HIJSMM301AJ5PR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggttgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccgaaggtaggaaagtacaaacggaaactaggtggcgtgcaccatctgttcttctatcttcccgt

SEQ ID NO: 568818 - DNA, 494 bp, Homo sapiens; identical to SEQ ID NO: 534994
  misc_feature: HIJSMM301B0KRM.27.78.H01.1.454.light.4.raw

SEQ ID NO: 568819 - DNA, 495 bp, Homo sapiens
  misc_feature: HIJSMM301DWFQJ.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggttttattattgtcaacaatattttagtgctccgtacacttttggccaggggaccaaggttggagatcaaacgactgtgg

SEQ ID NO: 568820 - DNA, 494 bp, Homo sapiens; identical to SEQ ID NO: 535629
  misc_feature: HIJSMM301BZ0GO.4.27.C05.1.454.light.4.raw

SEQ ID NO: 568821 - DNA, 495 bp, Homo sapiens
  misc_feature: HIJSMM301DEHOM.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacgaactgtggctgcaccatctgtctt

SEQ ID NO: 568822 - DNA, 455 bp, Homo sapiens
  misc_feature: HIJSMM301B6KQ3.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttctctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctcccacgagagta

SEQ ID NO: 568823 - DNA, 492 bp, Homo sapiens
  misc_feature: HIJSMM301D14AA.52.21.B10.1.454.light.4.raw
cgcagtacgacacgaccggtgctcgatttagtgtcgtcgcaagagagggggaaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctgggtccctgatcgcttctctggctccatccttgggaacaaagctgccctaaccatcacggggcccaggcagatgatgaatctgattattactgtgtcctctatatgggtagtggcatttggatgttcggcggagggacc

SEQ ID NO: 568824 - DNA, 473 bp, Homo sapiens
  misc_feature: HIJSMM301DAFDF.48.60.F05.1.454.light.4.raw
agtatacatacacgaccggtgctcgatttagtacgtcatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcggaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggaactgtggctgcaccatctgtcttcatcttccgccatctgatatgtatact

SEQ ID NO: 568825 - DNA, 505 bp, Homo sapiens; identical to SEQ ID NO: 555429
  misc_feature: HIJSMM301E1IOG.4.71.G05.1.454.light.4.raw

SEQ ID NO: 568826 - DNA, 485 bp, Homo sapiens; identical to SEQ ID NO: 545289
  misc_feature: HIJSMM301EA08E.19.71.G05.1.454.light.4.raw

SEQ ID NO: 568827 - DNA, 494 bp, Homo sapiens; identical to SEQ ID NO: 546380
  misc_feature: HIJSMM301A4TXQ.53.5.A05.1.454.light.4.raw

SEQ ID NO: 568828 - DNA, 480 bp, Homo sapiens
  misc_feature: HIJSMM301D46U5.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggcgatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaa

SEQ ID NO: 568829 - DNA, 507 bp, Homo sapiens
  misc_feature: HIJSMM301BF9OL.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtatactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcggggtgttcggcggagggaccaagctgaccgtcctaagtcagcccaaggctgccccctcggtcactctcg

SEQ ID NO: 568830 - DNA, 498 bp, Homo sapiens; identical to SEQ ID NO: 535469
  misc_feature: HIJSMM301DCXQX.12.18.B07.1.454.light.4.raw

SEQ ID NO: 568831 - DNA, 521 bp, Homo sapiens; identical to SEQ ID NO: 538715
  misc_feature: HIJSMM301CXSR3.27.23.C01.1.454.light.4.raw

SEQ ID NO: 568832 - DNA, 481 bp, Homo sapiens; identical to SEQ ID NO: 535993
  misc_feature: HIJSMM301CAHLR.21.25.C03.1.454.light.4.raw

SEQ ID NO: 568833 - DNA, 518 bp, Homo sapiens
  misc_feature: HIJSMM301EXXEV.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacgtcctaggtcagccaaggctgccccctcgtcactcctgttcccgccct

SEQ ID NO: 568834 - DNA, 486 bp, Homo sapiens; identical to SEQ ID NO: 535043
  misc_feature: HIJSMM301DLYGU.46.35.D02.1.454.light.4.raw

SEQ ID NO: 568835 - DNA, 494 bp, Homo sapiens; identical to SEQ ID NO: 536974
  misc_feature: HIJSMM301B6PAO.16.86.H09.1.454.light.4.raw

SEQ ID NO: 568836 - DNA, 440 bp, Homo sapiens; identical to SEQ ID NO: 558472
  misc_feature: HIJSMM301DMQJZ.11.3.A03.1.454.light.4.raw

SEQ ID NO: 568837 - DNA, 501 bp, Homo sapiens
  misc_feature: HIJSMM301EH7P4.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttggtgttcggcggagggaccaaactgaccgtcctaggtcagcccaa

SEQ ID NO: 568838 - DNA, 490 bp, Homo sapiens; identical to SEQ ID NO: 541141
  misc_feature: HIJSMM301AW04I.47.38.D05.1.454.light.4.raw

SEQ ID NO: 568839 - DNA, 497 bp, Homo sapiens
  misc_feature: HIJSMM301ENQF3.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtctccatcttccccg

SEQ ID NO: 568840 - DNA, 455 bp, Homo sapiens
  misc_feature: HIJSMM301A6QLP.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggatatcagacgaactgtggctgcaccatctgtcttcatcttcccgcatctgacacgagagta

SEQ ID NO: 568841 - DNA, 454 bp, Homo sapiens; identical to SEQ ID NO: 536347
  misc_feature: HIJSMM301A9ZAU.19.86.H09.1.454.light.4.raw

SEQ ID NO: 568842 - DNA, 511 bp, Homo sapiens
  misc_feature: HIJSMM301EGCPR.5.58.F03.1.454.light.4.raw
  modified_base (447)..(447): a, c, t, g, unknown or other
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttangttcgggactgggaccaaggtcaccgtcctaggtcagcccaaggccaacccactgtcactctcg

SEQ ID NO: 568843 - DNA, 507 bp, Homo sapiens; identical to SEQ ID NO: 535641
  misc_feature: HIJSMM301EFTSN.10.88.H11.1.454.light.4.raw

SEQ ID NO: 568844 - DNA, 491 bp, Homo sapiens; identical to SEQ ID NO: 544714
  misc_feature: HIJSMM301CKDZR.18.11.A11.1.454.light.4.raw

SEQ ID NO: 568845 - DNA, 493 bp, Homo sapiens; identical to SEQ ID NO: 535745
  misc_feature: HIJSMM301B2YMJ.47.78.H01.1.454.light.4.raw

SEQ ID NO: 568846 - DNA, 510 bp, Homo sapiens
  misc_feature: HIJSMM301CWE9U.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccc

SEQ ID NO: 568847 - DNA, 501 bp, Homo sapiens; identical to SEQ ID NO: 537690
  misc_feature: HIJSMM301BFTAD.41.14.B03.1.454.light.4.raw

SEQ ID NO: 568848 - DNA, 490 bp, Homo sapiens; identical to SEQ ID NO: 541567
  misc_feature: HIJSMM301AP82C.22.65.F10.1.454.light.4.raw

SEQ ID NO: 568849 - DNA, 472 bp, Homo sapiens; identical to SEQ ID NO: 535992
  misc_feature: HIJSMM301C86H8.11.76.G10.1.454.light.4.raw

SEQ ID NO: 568850 - DNA, 501 bp, Homo sapiens
  misc_feature: HIJSMM301C2AJ9.40.55.E11.1.454.light.4.raw
tctagcgactcacgaccggtgctcgatttagcactcgcacgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtgggggtgccacttgggtgttcggcggagggaccaagctgaccgtcctaggtcagcccaaggctgccccctc

SEQ ID NO: 568851 - DNA, 492 bp, Homo sapiens; identical to SEQ ID NO: 537395
  misc_feature: HIJSMM301EKA7Q.16.73.G07.1.454.light.4.raw

SEQ ID NO: 568852 - DNA, 499 bp, Homo sapiens; identical to SEQ ID NO: 557233
  misc_feature: HIJSMM301AJ0NR.12.18.B07.1.454.light.4.raw

SEQ ID NO: 568853 - DNA, 499 bp, Homo sapiens
  misc_feature: HIJSMM301AMAA0.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccaggctgaccgtcggcggtcagcccaaggctcgccccctcggtcactctcgttccc

SEQ ID NO: 568854 - DNA, 485 bp, Homo sapiens
  misc_feature: HIJSMM301BGH6Y.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcacatctgt

SEQ ID NO: 568855 - DNA, 503 bp, Homo sapiens
  misc_feature: HIJSMM301BGF8U.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgcccccc

SEQ ID NO: 568856 - DNA, 464 bp, Homo sapiens
  misc_feature: HIJSMM301CSK6A.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcccttgggaccagagtggacatgaaacgaa

SEQ ID NO: 568857 - DNA, 503 bp, Homo sapiens
  misc_feature: HIJSMM301AT1J7.41.27.C05.1.454.light.4.raw
tctatactatcacgaccggtgctcgatttagacgcgatcgaagggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtc

SEQ ID NO: 568858 - DNA, 454 bp, Homo sapiens; identical to SEQ ID NO: 535005
  misc_feature: HIJSMM301B6Y94.19.86.H09.1.454.light.4.raw

SEQ ID NO: 568859 - DNA, 506 bp, Homo sapiens
  misc_feature: HIJSMM301C5FN7.18.78.H01.1.454.light.4.raw
tacgagtatgcacgaccggtgctcgatttagtgtgagtagtttggggtttgggggggtcgtcaggaggcagcgctctcgggacggtctccaccatggcctgggcgtctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 568860 - DNA, 497 bp, Homo sapiens
  misc_feature: HIJSMM301AXX3U.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccc

SEQ ID NO: 568861 - DNA, 506 bp, Homo sapiens; identical to SEQ ID NO: 535058
  misc_feature: HIJSMM301DYPN4.17.41.D08.1.454.light.4.raw

SEQ ID NO: 568862 - DNA, 503 bp, Homo sapiens
  misc_feature: HIJSMM301B4ZTP.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagccttgtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatcagacgaactgtggctgcaccat

SEQ ID NO: 568863 - DNA, 504 bp, Homo sapiens
  misc_feature: HIJSMM301EJCSO.43.14.B03.1.454.light.4.raw
tgtgagtagtcacgaccggtgctcgatttagtgtgagtagttccgcggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcta

SEQ ID NO: 568864 - DNA, 488 bp, Homo sapiens
  misc_feature: HIJSMM301C6UXH.48.21.B10.1.454.light.4.raw
agtatacatacacgaccggtgctcgatttagtgtcgtcgcaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccaggtggaaatacaaacgaactagtggctgcaccatctgtcttcta

SEQ ID NO: 568865 - DNA, 502 bp, Homo sapiens; identical to SEQ ID NO: 537363
  misc_feature: HIJSMM301D8DSH.18.23.C01.1.454.light.4.raw

SEQ ID NO: 568866 - DNA, 526 bp, Homo sapiens
  misc_feature: HIJSMM301CCW92.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgaaggaccgaacggtaggaaggtacgaaacgaacctagtggcgtgcaccactctgtcttctacttttcccgtccctactcctga

SEQ ID NO: 568867 - DNA, 520 bp, Homo sapiens; identical to SEQ ID NO: 539176
  misc_feature: HIJSMM301CZ3M1.27.23.C01.1.454.light.4.raw

SEQ ID NO: 568868 - DNA, 488 bp, Homo sapiens; identical to SEQ ID NO: 535081
  misc_feature: HIJSMM301CPAP3.26.23.C01.1.454.light.4.raw

SEQ ID NO: 568869 - DNA, 496 bp, Homo sapiens; identical to SEQ ID NO: 535109
  misc_feature: HIJSMM301BL4IZ.16.78.H01.1.454.light.4.raw

SEQ ID NO: 568870 - DNA, 512 bp, Homo sapiens
  misc_feature: HIJSMM301CDARP.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgagacacgcg

SEQ ID NO: 568871 - DNA, 494 bp, Homo sapiens; identical to SEQ ID NO: 535497
  misc_feature: HIJSMM301EAHB1.43.72.G06.1.454.light.4.raw

SEQ ID NO: 568872 - DNA, 491 bp, Homo sapiens
  misc_feature: HIJSMM301C5SFY.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccgggtccctgacaggttcagtggcagtggatcaggcacagattttacactgaaaatcagcagagtggaggctgaggatgttggggtttattactgcatgcaagctctacaaactccttacacttttggccaggggaccaagctggagatacaaacgaactgt

SEQ ID NO: 568873 - DNA, 485 bp, Homo sapiens; identical to SEQ ID NO: 536040
  misc_feature: HIJSMM301BEE2M.15.1.A01.1.454.light.4.raw

SEQ ID NO: 568874 - DNA, 487 bp, Homo sapiens
  misc_feature: HIJSMM301B5J8X.17.26.C04.1.454.light.4.raw
  modified_base (435)..(435): a, c, t, g, unknown or other
cgtagactagcacgaccggtgctcgatttagtctagcgacttttgggtttgggggtcagtctcagtcaggacacagcatggacatgagggtccccggcctcagctcctggggcgtcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggntcactttcggcggagggaccaaggtggagatcaaacgaactgtggctgcacc

SEQ ID NO: 568875 - DNA, 490 bp, Homo sapiens; identical to SEQ ID NO: 535234
  misc_feature: HIJSMM301C5THG.17.21.B10.1.454.light.4.raw

SEQ ID NO: 568876 - DNA, 500 bp, Homo sapiens
  misc_feature: HIJSMM301A1VXC.52.53.E09.1.454.light.4.raw
cgcagtacgacacgaccggtgctcgatttagagagagtgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 568877 - DNA, 492 bp, Homo sapiens; identical to SEQ ID NO: 536010
  misc_feature: HIJSMM301EDBZC.10.20.B09.1.454.light.4.raw

SEQ ID NO: 568878 - DNA, 501 bp, Homo sapiens; identical to SEQ ID NO: 535746
  misc_feature: HIJSMM301AQGDO.18.11.A11.1.454.light.4.raw

SEQ ID NO: 568879 - DNA, 501 bp, Homo sapiens
  misc_feature: HIJSMM301EXNE1.52.28.C06.1.454.light.4.raw
cgcagtacgacacgaccggtgctcgatttagagctcacgtattgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 568880 - DNA, 505 bp, Homo sapiens
  misc_feature: HIJSMM301D4Y3Z.41.57.F02.1.454.light.4.raw
tctatactatcacgaccggtgctcgatttagctcgatatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctcgccccctcggt

SEQ ID NO: 568881 - DNA, 488 bp, Homo sapiens; identical to SEQ ID NO: 535081
  misc_feature: HIJSMM301BFC3N.26.23.C01.1.454.light.4.raw

SEQ ID NO: 568882 - DNA, 482 bp, Homo sapiens
  misc_feature: HIJSMM301BV5IS.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcgccaagggaccaaggtggaaagtacaaacgaacctgtggctgcacca

SEQ ID NO: 568883 - DNA, 490 bp, Homo sapiens
  misc_feature: HIJSMM301CA8T6.49.20.B09.1.454.light.4.raw
agtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggt

SEQ ID NO: 568884 - DNA, 492 bp, Homo sapiens; identical to SEQ ID NO: 535126
  misc_feature: HIJSMM301CPV7N.18.11.A11.1.454.light.4.raw

SEQ ID NO: 568885 - DNA, 490 bp, Homo sapiens; identical to SEQ ID NO: 535936
  misc_feature: HIJSMM301ENWQU.16.68.G02.1.454.light.4.raw

SEQ ID NO: 568886 - DNA, 495 bp, Homo sapiens; identical to SEQ ID NO: 535007
  misc_feature: HIJSMM301D1V57.22.5.A05.1.454.light.4.raw

SEQ ID NO: 568887 - DNA, 472 bp, Homo sapiens
  misc_feature: HIJSMM301B8O05.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccactacactttgtccagggaccgaacgactgagatcagacg

SEQ ID NO: 568888 - DNA, 485 bp, Homo sapiens
  misc_feature: HIJSMM301DO9O2.52.83.H06.1.454.light.4.raw
cgcagtacgacacgaccggtgctcgatttagatcacgtgcgtcgcggggcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggacaaggtcgagatcaaacgaactgtggctgcaccatctgtcttcta

SEQ ID NO: 568889 - DNA, 489 bp, Homo sapiens; identical to SEQ ID NO: 535139
  misc_feature: HIJSMM301DYQAD.14.55.E11.1.454.light.4.raw

SEQ ID NO: 568890 - DNA, 511 bp, Homo sapiens
  misc_feature: HIJSMM301BJ615.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaggtggagatcaaacgaactagtggctgcaccatctgtcttcta

SEQ ID NO: 568891 - DNA, 487 bp, Homo sapiens; identical to SEQ ID NO: 536025
  misc_feature: HIJSMM301DKBL1.17.34.D01.1.454.light.4.raw

SEQ ID NO: 568892 - DNA, 505 bp, Homo sapiens; identical to SEQ ID NO: 536232
  misc_feature: HIJSMM301C7EV6.47.65.F10.1.454.light.4.raw

SEQ ID NO: 568893 - DNA, 509 bp, Homo sapiens; identical to SEQ ID NO: 547321
  misc_feature: HIJSMM301COKN2.4.57.F02.1.454.light.4.raw

SEQ ID NO: 568894 - DNA, 496 bp, Homo sapiens
  misc_feature: HIJSMM301B8387.53.24.C02.1.454.light.4.raw
cgcgtatacacacgaccggtgctcgatttagtacagatcgttagggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatgtcctgcactgggaccagttccaacatcggggcagattatgatctacactggtatcagcaagttccaggaaccgcccccaaactcctcatctatggtaacaccaatcgaccctcaggggtccctgaccgattctctgcctccaagtctggcacctcagcctccctggccatcactgggctccagcctgaggatgaggctatttattactgccagtcctatgacaccagcctgagtggatcggtgttcggcggagggaccaaactgaccgtcctacg

SEQ ID NO: 568895 - DNA, 479 bp, Homo sapiens; identical to SEQ ID NO: 545213
  misc_feature: HIJSMM301A48IW.40.59.F04.1.454.light.4.raw

SEQ ID NO: 568896 - DNA, 520 bp, Homo sapiens; identical to SEQ ID NO: 539176
  misc_feature: HIJSMM301A7BF5.27.23.C01.1.454.light.4.raw

SEQ ID NO: 568897 - DNA, 504 bp, Homo sapiens
  misc_feature: HIJSMM301CEP68.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatggacaatctgagcggttgggtgttcggcggagggaccaaactgaccgtcctaggtcagcccaa

SEQ ID NO: 568898 - DNA, 494 bp, Homo sapiens; identical to SEQ ID NO: 535276
  misc_feature: HIJSMM301DUG15.16.6.A06.1.454.light.4.raw

SEQ ID NO: 568899 - DNA, 500 bp, Homo sapiens
  misc_feature: HIJSMM301BF927.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctcgccccctcggtcactctcg

SEQ ID NO: 568900 - DNA, 443 bp, Homo sapiens
  misc_feature: HIJSMM301AEVAR.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaggctgccccctcggtcactctgttcccgccctcctccgtgtctgat

SEQ ID NO: 568901 - DNA, 499 bp, Homo sapiens
  misc_feature: HIJSMM301D1GQY.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttctaagatattcggcggagggaccaggctgaccgtcctgagtcagcccaaggctg

SEQ ID NO: 568902 - DNA, 518 bp, Homo sapiens
  misc_feature: HIJSMM301DBB6Q.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagaccgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcctcctacg

SEQ ID NO: 568903 - DNA, 497 bp, Homo sapiens
  misc_feature: HIJSMM301A0J80.49.41.D08.1.454.light.4.raw
agtcgagagacacgaccggtgctcgatttagtcacgcgagaaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcta

SEQ ID NO: 568904 - DNA, 444 bp, Homo sapiens; identical to SEQ ID NO: 535192
  misc_feature: HIJSMM301BAVCY.5.9.A09.1.454.light.4.raw

SEQ ID NO: 568905 - DNA, 510 bp, Homo sapiens; identical to SEQ ID NO: 535855
  misc_feature: HIJSMM301DZ9FE.17.33.C11.1.454.light.4.raw

SEQ ID NO: 568906 - DNA, 506 bp, Homo sapiens; identical to SEQ ID NO: 534969
  misc_feature: HIJSMM301DL6RQ.18.37.D04.1.454.light.4.raw

SEQ ID NO: 568907 - DNA, 447 bp, Homo sapiens
  misc_feature: HIJSMM301A359B.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaagggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 568908 - DNA, 499 bp, Homo sapiens
  misc_feature: HIJSMM301D7XY2.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactaggaaattaaacgaactgtggctgcaccatctgtcttcatcttccccg

SEQ ID NO: 568909 - DNA, 506 bp, Homo sapiens
  misc_feature: HIJSMM301CQOZ7.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttagttactgcatgcaagctctacaaaactcctttacacttttggtccacggggaccgaacgactggaggatcaaacgaaactgtggtcg

SEQ ID NO: 568910 - DNA, 486 bp, Homo sapiens; identical to SEQ ID NO: 535043
  misc_feature: HIJSMM301EM79R.46.35.D02.1.454.light.4.raw

SEQ ID NO: 568911 - DNA, 484 bp, Homo sapiens; identical to SEQ ID NO: 535240
  misc_feature: HIJSMM301CURZZ.47.60.F05.1.454.light.4.raw

SEQ ID NO: 568912 - DNA, 487 bp, Homo sapiens
  misc_feature: HIJSMM301EPTQJ.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcgagatcagacgaactgtggctgcaccatctgtcttca

SEQ ID NO: 568913 - DNA, 495 bp, Homo sapiens; identical to SEQ ID NO: 543094
  misc_feature: HIJSMM301BPGA5.22.57.F02.1.454.light.4.raw

SEQ ID NO: 568914 - DNA, 444 bp, Homo sapiens; identical to SEQ ID NO: 536484
  misc_feature: HIJSMM301BMR9G.8.11.A11.1.454.light.4.raw

SEQ ID NO: 568915 - DNA, 497 bp, Homo sapiens
  misc_feature: HIJSMM301CAATD.40.71.G05.1.454.light.4.raw
tctagcgactcacgaccggtgctcgatttagtgtcgtcgcaagagagagggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcctaggtcag

SEQ ID NO: 568916 - DNA, 491 bp, Homo sapiens; identical to SEQ ID NO: 537594
  misc_feature: HIJSMM301CRQH8.4.24.C02.1.454.light.4.raw

SEQ ID NO: 568917 - DNA, 486 bp, Homo sapiens; identical to SEQ ID NO: 537144
  misc_feature: HIJSMM301CTAD9.46.35.D02.1.454.light.4.raw

SEQ ID NO: 568918 - DNA, 489 bp, Homo sapiens
  misc_feature: HIJSMM301A70TA.14.53.E09.1.454.light.4.raw
cgtctagtaccacgaccggtgctcgatttagagagagtgtgttgggtttggggggggaggcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcgggcggagggaccaagctgacccgtccta

SEQ ID NO: 568919 - DNA, 520 bp, Homo sapiens
  misc_feature: HIJSMM301A9ZRZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccgaacggaccgaacggtaggaaggtacgaaacgaactacgtggcgtgcaccactctgtcttctatcttcccgtcccact

SEQ ID NO: 568920 - DNA, 486 bp, Homo sapiens; identical to SEQ ID NO: 548219
  misc_feature: HIJSMM301ELWGB.5.6.A06.1.454.light.4.raw

SEQ ID NO: 568921 - DNA, 491 bp, Homo sapiens; identical to SEQ ID NO: 535194
  misc_feature: HIJSMM301BN40A.26.78.H01.1.454.light.4.raw

SEQ ID NO: 568922 - DNA, 493 bp, Homo sapiens; identical to SEQ ID NO: 536471
  misc_feature: HIJSMM301D7Y2S.3.71.G05.1.454.light.4.raw

SEQ ID NO: 568923 - DNA, 498 bp, Homo sapiens
  misc_feature: HIJSMM301CQBQV.52.25.C03.1.454.light.4.raw
cgcagtacgacacgaccggtgctcgatttagtagtgtagatttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtctaggtcagcccaaggctgccccctcggtcact

SEQ ID NO: 568924 - DNA, 457 bp, Homo sapiens
  misc_feature: HIJSMM301A2JL3.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttcccaccctcctcatagtataga

SEQ ID NO: 568925 - DNA, 482 bp, Homo sapiens; identical to SEQ ID NO: 535697
  misc_feature: HIJSMM301BOC3G.13.8.A08.1.454.light.4.raw

SEQ ID NO: 568926 - DNA, 502 bp, Homo sapiens
  misc_feature: HIJSMM301DDI36.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatggaggctgactattactgtgcatcacgggacgcaacatgggatgacaatctgagcggttggtgttcggcggagggaccaaactgaccgtcctaggtcagcccaa

SEQ ID NO: 568927 - DNA, 474 bp, Homo sapiens; identical to SEQ ID NO: 558221
  misc_feature: HIJSMM301DAHGV.12.49.E05.1.454.light.4.raw

SEQ ID NO: 568928 - DNA, 486 bp, Homo sapiens; identical to SEQ ID NO: 535043
  misc_feature: HIJSMM301EUFY9.46.35.D02.1.454.light.4.raw

SEQ ID NO: 568929 - DNA, 492 bp, Homo sapiens; identical to SEQ ID NO: 542642
  misc_feature: HIJSMM301DVYND.51.81.H04.1.454.light.4.raw

SEQ ID NO: 568930 - DNA, 507 bp, Homo sapiens; identical to SEQ ID NO: 556766
  misc_feature: HIJSMM301CFR9K.8.34.D01.1.454.light.4.raw

SEQ ID NO: 568931 - DNA, 454 bp, Homo sapiens; identical to SEQ ID NO: 535005
  misc_feature: HIJSMM301CB1VZ.19.86.H09.1.454.light.4.raw

SEQ ID NO: 568932 - DNA, 496 bp, Homo sapiens
  misc_feature: HIJSMM301CUMUR.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattacttgcatgcaagttctacaaacttcctacacttttggccaggggaccaagctggagatcaaacgaactgtggctgca

SEQ ID NO: 568933 - DNA, 522 bp, Homo sapiens; identical to SEQ ID NO: 567930
  misc_feature: HIJSMM301ER43G.27.23.C01.1.454.light.4.raw

SEQ ID NO: 568934 - DNA, 484 bp, Homo sapiens
  misc_feature: HIJSMM301CNWKC.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattatgtcaatcagcagacaacagtaatacttatctttatgtcttcggatctgggaccagggtcaccgtcctaggtcagcccaaggccaa

SEQ ID NO: 568935 - DNA, 473 bp, Homo sapiens; identical to SEQ ID NO: 538060
  misc_feature: HIJSMM301BM28W.18.76.G10.1.454.light.4.raw

SEQ ID NO: 568936 - DNA, 501 bp, Homo sapiens; identical to SEQ ID NO: 556515
  misc_feature: HIJSMM301BOR18.21.22.B11.1.454.light.4.raw

SEQ ID NO: 568937 - DNA, 517 bp, Homo sapiens
  misc_feature: HIJSMM301DFXSM.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacacg

SEQ ID NO: 568938 - DNA, 471 bp, Homo sapiens; identical to SEQ ID NO: 550299
  misc_feature: HIJSMM301BWT88.7.81.H04.1.454.light.4.raw

SEQ ID NO: 568939 - DNA, 446 bp, Homo sapiens; identical to SEQ ID NO: 536106
  misc_feature: HIJSMM301BGO5N.18.9.A09.1.454.light.4.raw

SEQ ID NO: 568940 - DNA, 486 bp, Homo sapiens
  misc_feature: HIJSMM301C0N90.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaaggaaacacagcctccctgaccattactggactccaacctgaggacgaggctgactattattgctcagcatgggacaccacgcctcaatgccgcggtattcggcgcagggaccaagctgaccgtccgtaggtcacg

SEQ ID NO: 568941 - DNA, 501 bp, Homo sapiens
  misc_feature: HIJSMM301D77CR.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagccaaggctgccccctgt

SEQ ID NO: 568942 - DNA, 500 bp, Homo sapiens
  misc_feature: HIJSMM301DEYDI.48.35.D02.1.454.light.4.raw
agtatacatacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 568943 - DNA, 484 bp, Homo sapiens; identical to SEQ ID NO: 535400
  misc_feature: HIJSMM301EV8H7.46.26.C04.1.454.light.4.raw

SEQ ID NO: 568944 - DNA, 476 bp, Homo sapiens; identical to SEQ ID NO: 538611
  misc_feature: HIJSMM301C4I1K.7.81.H04.1.454.light.4.raw

SEQ ID NO: 568945 - DNA, 473 bp, Homo sapiens; identical to SEQ ID NO: 535262
  misc_feature: HIJSMM301AULU8.8.67.G01.1.454.light.4.raw

SEQ ID NO: 568946 - DNA, 487 bp, Homo sapiens
  misc_feature: HIJSMM301CSQIJ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatcgtagggcagatttcactctcaccatcaatcacctgcaggctgaggtattttgcaacttactactgtcagcaggctaacaggctcgcccccaaccttcggccaggggacacgactggagattaaacgaactgtgctgcacatctgtt

SEQ ID NO: 568947 - DNA, 486 bp, Homo sapiens; identical to SEQ ID NO: 537617
  misc_feature: HIJSMM301AV090.10.53.E09.1.454.light.4.raw

SEQ ID NO: 568948 - DNA, 517 bp, Homo sapiens
  misc_feature: HIJSMM301AL9CF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtactgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccca

SEQ ID NO: 568949 - DNA, 494 bp, Homo sapiens; identical to SEQ ID NO: 534994
  misc_feature: HIJSMM301ET2KT.27.78.H01.1.454.light.4.raw

SEQ ID NO: 568950 - DNA, 503 bp, Homo sapiens; identical to SEQ ID NO: 542867
  misc_feature: HIJSMM301DKGNE.14.57.F02.1.454.light.4.raw

SEQ ID NO: 568951 - DNA, 494 bp, Homo sapiens; identical to SEQ ID NO: 543247
  misc_feature: HIJSMM301CDQLR.22.57.F02.1.454.light.4.raw

SEQ ID NO: 568952 - DNA, 523 bp, Homo sapiens
  misc_feature: HIJSMM301EB9OF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaaacgaacctagtggcgtgcgaccactctgtcttcactcttcccgtcccact

SEQ ID NO: 568953 - DNA, 486 bp, Homo sapiens; identical to SEQ ID NO: 535385
  misc_feature: HIJSMM301AXB7V.19.71.G05.1.454.light.4.raw

SEQ ID NO: 568954 - DNA, 489 bp, Homo sapiens; identical to SEQ ID NO: 535139
  misc_feature: HIJSMM301DJ24P.14.55.E11.1.454.light.4.raw

SEQ ID NO: 568955 - DNA, 479 bp, Homo sapiens; identical to SEQ ID NO: 535665
  misc_feature: HIJSMM301AMP4Z.12.10.A10.1.454.light.4.raw

SEQ ID NO: 568956 - DNA, 500 bp, Homo sapiens
  misc_feature: HIJSMM301BQIUU.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttactagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacca

SEQ ID NO: 568957 - DNA, 457 bp, Homo sapiens; identical to SEQ ID NO: 536586
  misc_feature: HIJSMM301CWLXU.49.85.H08.1.454.light.4.raw

SEQ ID NO: 568958 - DNA, 496 bp, Homo sapiens
  misc_feature: HIJSMM301BA9RW.49.78.H01.1.454.light.4.raw
agtcgagagacacgaccggtgctcgatttagtgtgagtagtttgggtttgggggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtctt

SEQ ID NO: 568959 - DNA, 517 bp, Homo sapiens; identical to SEQ ID NO: 536980
  misc_feature: HIJSMM301EP4Y5.5.27.C05.1.454.light.4.raw

SEQ ID NO: 568960 - DNA, 480 bp, Homo sapiens
  misc_feature: HIJSMM301DCOE5.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggcaagggaccaggtggaatcaacgaactgtgg

SEQ ID NO: 568961 - DNA, 500 bp, Homo sapiens
  misc_feature: HIJSMM301BWBJM.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaacccactgtca

SEQ ID NO: 568962 - DNA, 485 bp, Homo sapiens; identical to SEQ ID NO: 536040
  misc_feature: HIJSMM301CBSIE.15.1.A01.1.454.light.4.raw

SEQ ID NO: 568963 - DNA, 504 bp, Homo sapiens
  misc_feature: HIJSMM301DL5Z7.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagtatttttataagtatgtctcctggtaccaacaacgcccaggcaaacgcccccaagctcatgatttatgaggtcattaagcggccctcgagggtccctcatcgcttctctggctccaagtctggcaacacggcctccctgaccgtctctgggctccaggctgaggatgaggctacttattactgcagttcatatgcagacagcaactaattcatattcggcggagggaccaggctgaccgtctgggtcagccaaggctcgcccctcggtcactctgtcccgccctcctccgtgt

SEQ ID NO: 568964 - DNA, 513 bp, Homo sapiens
  misc_feature: HIJSMM301ALBE0.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccacctcctcga

SEQ ID NO: 568965 - DNA, 503 bp, Homo sapiens; identical to SEQ ID NO: 550542
  misc_feature: HIJSMM301B5AVH.2.76.G10.1.454.light.4.raw

SEQ ID NO: 568966 - DNA, 511 bp, Homo sapiens; identical to SEQ ID NO: 541549
  misc_feature: HIJSMM301BOUFC.40.33.C11.1.454.light.4.raw

SEQ ID NO: 568967 - DNA, 484 bp, Homo sapiens
  misc_feature: HIJSMM301DOKH6.47.77.G11.1.454.light.4.raw
agctcacgtacacgaccggtgctcgatttagctagtcactcaagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacc

SEQ ID NO: 568968 - DNA, 505 bp, Homo sapiens; identical to SEQ ID NO: 538422
  misc_feature: HIJSMM301DTMM1.19.78.H01.1.454.light.4.raw

SEQ ID NO: 568969 - DNA, 497 bp, Homo sapiens
  misc_feature: HIJSMM301CCHRH.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagtattttgctagtttattactgtcagcagtataataactggcctccggtctacgtttcggcggagggaccgaagggtggagatacaaacgaactggtggctgcaccat

SEQ ID NO: 568970 - DNA, 503 bp, Homo sapiens
  misc_feature: HIJSMM301D0WFL.22.46.E02.1.454.light.4.raw
acatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagcccccaactcttaattttggtgtcaataaccgccctcaggggtccctgatcgcttctccggctccaagtctggcaacacggcctccctgaccatctctggactccaggctgacgatgagggtgacttttactgctgctcatatgcaggcggcaactcttgggtgttcggcggagggaccaagctgaccgtcctaggtcagcccaaggctcgcccctcggtcact

SEQ ID NO: 568971 - DNA, 487 bp, Homo sapiens; identical to SEQ ID NO: 536179
  misc_feature: HIJSMM301D96OG.19.57.F02.1.454.light.4.raw

SEQ ID NO: 568972 - DNA, 497 bp, Homo sapiens
  misc_feature: HIJSMM301AVKDD.16.6.A06.1.454.light.4.raw
tgtactactccacgaccggtgctcgatttagatctactgacaagggggaggctacaacaggcaggcaggggcacgcaagatggtgttgcagacccagggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaagaactgtggctgcaccat

SEQ ID NO: 568973 - DNA, 509 bp, Homo sapiens; identical to SEQ ID NO: 540142
  misc_feature: HIJSMM301BODWM.8.38.D05.1.454.light.4.raw

SEQ ID NO: 568974 - DNA, 503 bp, Homo sapiens
  misc_feature: HIJSMM301CJDDL.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctacacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactc

SEQ ID NO: 568975 - DNA, 479 bp, Homo sapiens; identical to SEQ ID NO: 561311
  misc_feature: HIJSMM301EJ7J9.11.11.A11.1.454.light.4.raw

SEQ ID NO: 568976 - DNA, 490 bp, Homo sapiens
  misc_feature: HIJSMM301AHWE1.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggtccagggaccaaactaggacatcaaacgaactagtggctgcaccatctgtt

SEQ ID NO: 568977 - DNA, 461 bp, Homo sapiens
  misc_feature: HIJSMM301CO23Q.49.10.A10.1.454.light.4.raw
agtcgagagacacgaccggtgctcgatttagcgtcgatctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttacttcaccatcagcagactgcagcctgaagatattgcaacatattactgtcaacagtatgataatctcccgctcactttcggcggagggaccaaggtggagatcaaacgaa

SEQ ID NO: 568978 - DNA, 497 bp, Homo sapiens; identical to SEQ ID NO: 534982
  misc_feature: HIJSMM301D0Q50.26.80.H03.1.454.light.4.raw

SEQ ID NO: 568979 - DNA, 494 bp, Homo sapiens; identical to SEQ ID NO: 534992
  misc_feature: HIJSMM301CTRP0.9.1.A01.1.454.light.4.raw

SEQ ID NO: 568980 - DNA, 496 bp, Homo sapiens; identical to SEQ ID NO: 535541
  misc_feature: HIJSMM301A0AOP.3.33.C11.1.454.light.4.raw

SEQ ID NO: 568981 - DNA, 484 bp, Homo sapiens; identical to SEQ ID NO: 535400
  misc_feature: HIJSMM301DBQ06.46.26.C04.1.454.light.4.raw

SEQ ID NO: 568982 - DNA, 478 bp, Homo sapiens; identical to SEQ ID NO: 535129
  misc_feature: HIJSMM301BM70J.11.11.A11.1.454.light.4.raw

SEQ ID NO: 568983 - DNA, 505 bp, Homo sapiens
  misc_feature: HIJSMM301EMQC6.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccatgtca

SEQ ID NO: 568984 - DNA, 502 bp, Homo sapiens; identical to SEQ ID NO: 551357
  misc_feature: HIJSMM301DH0WX.9.12.B01.1.454.light.4.raw

SEQ ID NO: 568985 - DNA, 496 bp, Homo sapiens
  misc_feature: HIJSMM301D6ZBZ.43.37.D04.1.454.light.4.raw
  modified_base (480)..(480): a, c, t, g, unknown or other
tgtgagtagtcacgaccggtgctcgatttagtagcatactgttgggtttggggtcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtnaccgtcctaggtcacg

SEQ ID NO: 568986 - DNA, 464 bp, Homo sapiens; identical to SEQ ID NO: 537214
  misc_feature: HIJSMM301DYDEE.18.59.F04.1.454.light.4.raw

SEQ ID NO: 568987 - DNA, 483 bp, Homo sapiens; identical to SEQ ID NO: 544786
  misc_feature: HIJSMM301CUD3C.46.26.C04.1.454.light.4.raw

SEQ ID NO: 568988 - DNA, 493 bp, Homo sapiens; identical to SEQ ID NO: 537281
  misc_feature: HIJSMM301AWB3V.9.1.A01.1.454.light.4.raw

SEQ ID NO: 568989 - DNA, 483 bp, Homo sapiens; identical to SEQ ID NO: 535013
  misc_feature: HIJSMM301DOD2X.11.76.G10.1.454.light.4.raw

SEQ ID NO: 568990 - DNA, 505 bp, Homo sapiens; identical to SEQ ID NO: 536233
  misc_feature: HIJSMM301CWFH9.48.25.C03.1.454.light.4.raw

SEQ ID NO: 568991 - DNA, 502 bp, Homo sapiens
  misc_feature: HIJSMM301DN726.48.54.E10.1.454.light.4.raw
agtatacatacacgaccggtgctcgatttagatcgtagcagaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcacttctctccatcagcagactggagcctgaagattttgcaatttattactgtcaccagtatggtagctcacctctaactttcggcggagggaccgaaggtggaggatcaaacgaactagtggctacaccatctgtctt

SEQ ID NO: 568992 - DNA, 483 bp, Homo sapiens; identical to SEQ ID NO: 535413
  misc_feature: HIJSMM301BKBU6.26.78.H01.1.454.light.4.raw

SEQ ID NO: 568993 - DNA, 513 bp, Homo sapiens; identical to SEQ ID NO: 547639
  misc_feature: HIJSMM301EWOVV.43.59.F04.1.454.light.4.raw

SEQ ID NO: 568994 - DNA, 485 bp, Homo sapiens; identical to SEQ ID NO: 543441
  misc_feature: HIJSMM301B3YJT.26.55.E11.1.454.light.4.raw

SEQ ID NO: 568995 - DNA, 495 bp, Homo sapiens
  misc_feature: HIJSMM301EFOT1.52.42.D09.1.454.light.4.raw
cgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 568996 - DNA, 480 bp, Homo sapiens; identical to SEQ ID NO: 546518
  misc_feature: HIJSMM301C1UW5.4.39.D06.1.454.light.4.raw

SEQ ID NO: 568997 - DNA, 481 bp, Homo sapiens
  misc_feature: HIJSMM301BKYX1.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaaggctggagatcaaacgaa

SEQ ID NO: 568998 - DNA, 498 bp, Homo sapiens; identical to SEQ ID NO: 535295
  misc_feature: HIJSMM301BO9D8.15.25.C03.1.454.light.4.raw

SEQ ID NO: 568999 - DNA, 473 bp, Homo sapiens; identical to SEQ ID NO: 535262
  misc_feature: HIJSMM301A7YKH.8.67.G01.1.454.light.4.raw

SEQ ID NO: 569000 - DNA, 505 bp, Homo sapiens
  misc_feature: HIJSMM301AVWUY.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaaccccactgtca

SEQ ID NO: 569001 - DNA, 504 bp, Homo sapiens
  misc_feature: HIJSMM301EL74U.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacggttcggccaagggaccgaacggtaggaaatacaaacgaactagtggctgcacc

SEQ ID NO: 569002 - DNA, 505 bp, Homo sapiens; identical to SEQ ID NO: 539292
  misc_feature: HIJSMM301B696Z.19.85.H08.1.454.light.4.raw

SEQ ID NO: 569003 - DNA, 505 bp, Homo sapiens; identical to SEQ ID NO: 539292
  misc_feature: HIJSMM301DQSZY.19.85.H08.1.454.light.4.raw

SEQ ID NO: 569004 - DNA, 501 bp, Homo sapiens
  misc_feature: HIJSMM301EH37U.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcaacagaatctgaggatgctgcattttacttcggtctacaacatgataatttccctccgtggaccgttcggccaagggaccaaggagcaaaatcaaacgaactgtggctgcaccatctgtcttcactcttcccgccat

SEQ ID NO: 569005 - DNA, 493 bp, Homo sapiens; identical to SEQ ID NO: 544107
  misc_feature: HIJSMM301BMXAY.49.20.B09.1.454.light.4.raw

SEQ ID NO: 569006 - DNA, 485 bp, Homo sapiens
  misc_feature: HIJSMM301BBPOG.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 569007 - DNA, 501 bp, Homo sapiens
  misc_feature: HIJSMM301AMVSJ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcacgtcctaggtcagcccaaggccaaccccactgtca

SEQ ID NO: 569008 - DNA, 485 bp, Homo sapiens
  misc_feature: HIJSMM301BFH4B.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccgagggtggagatcagacgaa

SEQ ID NO: 569009 - DNA, 497 bp, Homo sapiens
  misc_feature: HIJSMM301EKXJ8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttcta

SEQ ID NO: 569010 - DNA, 490 bp, Homo sapiens; identical to SEQ ID NO: 535420
  misc_feature: HIJSMM301A4ZEV.3.72.G06.1.454.light.4.raw

SEQ ID NO: 569011 - DNA, 505 bp, Homo sapiens; identical to SEQ ID NO: 559871
  misc_feature: HIJSMM301BYWEN.9.12.B01.1.454.light.4.raw

SEQ ID NO: 569012 - DNA, 482 bp, Homo sapiens; identical to SEQ ID NO: 544399
  misc_feature: HIJSMM301D9XMH.5.39.D06.1.454.light.4.raw

SEQ ID NO: 569013 - DNA, 509 bp, Homo sapiens; identical to SEQ ID NO: 543741
  misc_feature: HIJSMM301EQCD2.17.33.C11.1.454.light.4.raw

SEQ ID NO: 569014 - DNA, 492 bp, Homo sapiens; identical to SEQ ID NO: 534967
  misc_feature: HIJSMM301D0G01.47.64.F09.1.454.light.4.raw

SEQ ID NO: 569015 - DNA, 488 bp, Homo sapiens; identical to SEQ ID NO: 537260
  misc_feature: HIJSMM301DXGPR.47.70.G04.1.454.light.4.raw

SEQ ID NO: 569016 - DNA, 521 bp, Homo sapiens
  misc_feature: HIJSMM301AVC5A.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgaacggacgaacggtaggaaggtacgaaacgaaacgtacgtaggtcgtgcgaccactctgtcttctatcttcccgtcccact

SEQ ID NO: 569017 - DNA, 497 bp, Homo sapiens
  misc_feature: HIJSMM301D80SP.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccaccctcctcc

SEQ ID NO: 569018 - DNA, 486 bp, Homo sapiens; identical to SEQ ID NO: 537310
  misc_feature: HIJSMM301CE8IR.15.28.C06.1.454.light.4.raw

SEQ ID NO: 569019 - DNA, 495 bp, Homo sapiens; identical to SEQ ID NO: 535596
  misc_feature: HIJSMM301BHI2R.10.79.H02.1.454.light.4.raw

SEQ ID NO: 569020 - DNA, 484 bp, Homo sapiens
  misc_feature: HIJSMM301B59PN.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacg

SEQ ID NO: 569021 - DNA, 502 bp, Homo sapiens; identical to SEQ ID NO: 545613
  misc_feature: HIJSMM301DFKX8.22.15.B04.1.454.light.4.raw

SEQ ID NO: 569022 - DNA, 514 bp, Homo sapiens; identical to SEQ ID NO: 540552
  misc_feature: HIJSMM301A6C6W.16.66.F11.1.454.light.4.raw

SEQ ID NO: 569023 - DNA, 506 bp, Homo sapiens
  misc_feature: HIJSMM301AOGEO.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggttgttcggcggagggaccaagctgaccgtcctaggtcagcccaaggctcgccccctcggt

SEQ ID NO: 569024 - DNA, 492 bp, Homo sapiens
  misc_feature: HIJSMM301BCT2V.51.23.C01.1.454.light.4.raw
cgatcgtatacacgaccggtgctcgatttagtacacgtgattagggattggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcgggctgtggatgaggctgactttactgtcaggcgtgggacagcgacactgccgtgttcggcgggggaccaagctgaccgtcctcggtcagcccaaggctgccccctcggtcact

SEQ ID NO: 569025 - DNA, 441 bp, Homo sapiens; identical to SEQ ID NO: 546257
  misc_feature: HIJSMM301B6LDD.41.9.A09.1.454.light.4.raw

SEQ ID NO: 569026 - DNA, 364 bp, Homo sapiens
  misc_feature: HIJSMM301B7NN9.19.31.C09.1.454.light.4.raw
tactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaaacaataagaactacttaacttggtatcagcagaaaccaggacagcctcctaaggtgctcatttcctgggcatctacccgggaatccggggtccctgaccgattcagtggcagcgggtctgggacagatttcactctcagca

SEQ ID NO: 569027 - DNA, 498 bp, Homo sapiens
  misc_feature: HIJSMM301D7TIZ.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaagggtggagatcaaacgaactgtggctgcaccta

SEQ ID NO: 569028 - DNA, 518 bp, Homo sapiens
  misc_feature: HIJSMM301DFXQ1.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccgaaggaccaaggtggcaatcaaccgaactgtggctgcaccatctgtcttcatcttccccg

SEQ ID NO: 569029 - DNA, 481 bp, Homo sapiens; identical to SEQ ID NO: 535993
  misc_feature: HIJSMM301AKMWM.21.25.C03.1.454.light.4.raw

SEQ ID NO: 569030 - DNA, 496 bp, Homo sapiens; identical to SEQ ID NO: 535109
  misc_feature: HIJSMM301AKR0D.16.78.H01.1.454.light.4.raw

SEQ ID NO: 569031 - DNA, 514 bp, Homo sapiens
  misc_feature: HIJSMM301EEJI3.13.73.G07.1.454.light.4.raw
tcacgtactacacgaccggtgctcgatttagctctacgctcaggggggggtcgacaagaggcagcgctctcgggacggtctccaccatggcctgggctctgctgctcctcactctcctcactcaggacacagggtcctgggcccgagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttacttgtgttcatatgcaggaaggagtgattatgtctttggaagtgggaccaaaggtcaccgtccttggtcagcccaaggccaaccccactgtcactctgttcccg

SEQ ID NO: 569032 - DNA, 491 bp, Homo sapiens; identical to SEQ ID NO: 535176
  misc_feature: HIJSMM301DC6I6.13.39.D06.1.454.light.4.raw

SEQ ID NO: 569033 - DNA, 494 bp, Homo sapiens; identical to SEQ ID NO: 534994
  misc_feature: HIJSMM301AXUBA.27.78.H01.1.454.light.4.raw

SEQ ID NO: 569034 - DNA, 490 bp, Homo sapiens
  misc_feature: HIJSMM301A8YBS.15.1.A01.1.454.light.4.raw
tctacgtagccacgaccggtgctcgatttagacgtctcatcagggcctgggctctgctgctcctcactctcctcactcaggacacagggtcctgggccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggacaagctgaccgtcctgcgtcagcccaaggctcgccccctcggtccactctcgttccacccctccctccgctacgtagaa

SEQ ID NO: 569035 - DNA, 478 bp, Homo sapiens
  misc_feature: HIJSMM301A1IJ9.48.41.D08.1.454.light.4.raw
agtatacatacacgaccggtgctcgatttagtcacgcgagaaagggaaaggggggtcgtcaggaggcagcactctcggacgtctccaccatggcctggcgtctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtca

SEQ ID NO: 569036 - DNA, 489 bp, Homo sapiens; identical to SEQ ID NO: 535091
  misc_feature: HIJSMM301DIUDV.47.36.D03.1.454.light.4.raw

SEQ ID NO: 569037 - DNA, 507 bp, Homo sapiens; identical to SEQ ID NO: 559118
  misc_feature: HIJSMM301DKEN6.17.87.H10.1.454.light.4.raw

SEQ ID NO: 569038 - DNA, 490 bp, Homo sapiens; identical to SEQ ID NO: 535234
  misc_feature: HIJSMM301DCB71.17.21.B10.1.454.light.4.raw

SEQ ID NO: 569039 - DNA, 485 bp, Homo sapiens; identical to SEQ ID NO: 538053
  misc_feature: HIJSMM301EPWCC.13.5.A05.1.454.light.4.raw

SEQ ID NO: 569040 - DNA, 444 bp, Homo sapiens; identical to SEQ ID NO: 535027
  misc_feature: HIJSMM301ERDH1.8.73.G07.1.454.light.4.raw

SEQ ID NO: 569041 - DNA, 511 bp, Homo sapiens; identical to SEQ ID NO: 539247
  misc_feature: HIJSMM301B4RRV.15.34.D01.1.454.light.4.raw

SEQ ID NO: 569042 - DNA, 469 bp, Homo sapiens
  misc_feature: HIJSMM301EJFPV.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaaggatagaaatacaaacgaa

SEQ ID NO: 569043 - DNA, 516 bp, Homo sapiens; identical to SEQ ID NO: 546969
  misc_feature: HIJSMM301DFIXX.22.30.C08.1.454.light.4.raw

SEQ ID NO: 569044 - DNA, 491 bp, Homo sapiens; identical to SEQ ID NO: 535294
  misc_feature: HIJSMM301AKHPN.16.68.G02.1.454.light.4.raw

SEQ ID NO: 569045 - DNA, 493 bp, Homo sapiens
  misc_feature: HIJSMM301ENT2K.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgt

SEQ ID NO: 569046 - DNA, 494 bp, Homo sapiens
  misc_feature: HIJSMM301DTF15.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtctagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 569047 - DNA, 532 bp, Homo sapiens
  misc_feature: HIJSMM301A1BQ8.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaaacgcagggatattactcatctctgggctccagtctgacgatgaggctgactattaactgtttgacttggcacaacaaacgacctggatactcggtaccgttcgggaccgaccgggtaccaccggtaccctcggttacgtacgccacgaaccgaacccaccaccgtacactactcttccccg

SEQ ID NO: 569048 - DNA, 494 bp, Homo sapiens; identical to SEQ ID NO: 534992
  misc_feature: HIJSMM301BG1M0.9.1.A01.1.454.light.4.raw

SEQ ID NO: 569049 - DNA, 494 bp, Homo sapiens; identical to SEQ ID NO: 534992
  misc_feature: HIJSMM301A4J5B.9.1.A01.1.454.light.4.raw

SEQ ID NO: 569050 - DNA, 447 bp, Homo sapiens; identical to SEQ ID NO: 535020
  misc_feature: HIJSMM301BQBCX.18.9.A09.1.454.light.4.raw

SEQ ID NO: 569051 - DNA, 495 bp, Homo sapiens; identical to SEQ ID NO: 535821
  misc_feature: HIJSMM301EMHNC.3.31.C09.1.454.light.4.raw

SEQ ID NO: 569052 - DNA, 514 bp, Homo sapiens
  misc_feature: HIJSMM301AXK98.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccttggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 569053 - DNA, 489 bp, Homo sapiens; identical to SEQ ID NO: 536663
  misc_feature: HIJSMM301ERSN2.16.72.G06.1.454.light.4.raw

SEQ ID NO: 569054 - DNA, 497 bp, Homo sapiens
  misc_feature: HIJSMM301CW0W3.53.8.A08.1.454.light.4.raw
cgcgtatacacacgaccggtgctcgatttagcatactctacagggggtgggtccaggaggcagaactctgggtgtctcaccatggcctggatccctctacttctccccctcctcactctctgcacaggctctgaggcctcccatgagttgatacagccatcctcggtgtcagtgtccccaggacagacggccacgattatttgctctggagatgcattggcaaagcaatttgcttcttggttccagcagaagccaggccaagcccctgtactggtgatttataaaggctctgagaggcccccagggatccctgagcgattctctgggtccgactcagggacaacagccatgttgaccatcagtggagtccaggcagaagacgaggctgactattattgtcagtcagcagacaacactgttgtttctgtgtttttcggcggagggaccaggctgaccgtcctgggtcagcccaaggctgccccctcggtcactctgtt

SEQ ID NO: 569055 - DNA, 443 bp, Homo sapiens; identical to SEQ ID NO: 549023
  misc_feature: HIJSMM301DX31I.8.73.G07.1.454.light.4.raw

SEQ ID NO: 569056 - DNA, 520 bp, Homo sapiens
  misc_feature: HIJSMM301A814M.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccgaaggtggcaatcaaccgaactgtggctgcaccatctgtcttcatccttccccg

SEQ ID NO: 569057 - DNA, 491 bp, Homo sapiens
  misc_feature: HIJSMM301CM367.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcacttttcggcggagggaccaaggtggagatcaagcgaactgtggctgcaccatctgtctt

SEQ ID NO: 569058 - DNA, 509 bp, Homo sapiens
  misc_feature: HIJSMM301DE0Y0.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactgtggcgtgcaccatctgtctt

SEQ ID NO: 569059 - DNA, 494 bp, Homo sapiens; identical to SEQ ID NO: 534992
  misc_feature: HIJSMM301ERMW8.9.1.A01.1.454.light.4.raw

SEQ ID NO: 569060 - DNA, 480 bp, Homo sapiens; identical to SEQ ID NO: 535291
  misc_feature: HIJSMM301EW47P.22.59.F04.1.454.light.4.raw

SEQ ID NO: 569061 - DNA, 506 bp, Homo sapiens; identical to SEQ ID NO: 534969
  misc_feature: HIJSMM301BB6LP.18.37.D04.1.454.light.4.raw

SEQ ID NO: 569062 - DNA, 519 bp, Homo sapiens
  misc_feature: HIJSMM301ERISV.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctggtcactctgttcccaccct

SEQ ID NO: 569063 - DNA, 460 bp, Homo sapiens; identical to SEQ ID NO: 539417
  misc_feature: HIJSMM301EVZG1.43.66.F11.1.454.light.4.raw

SEQ ID NO: 569064 - DNA, 474 bp, Homo sapiens
  misc_feature: HIJSMM301BL14V.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggtaccaagggtggacatcaaacgaa

SEQ ID NO: 569065 - DNA, 476 bp, Homo sapiens
  misc_feature: HIJSMM301CU1LR.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctgtcatatctggtctccagggtgaggatgaggctgattattactgccactcctatgacacagcctgagtattggctgttcggcggcgggacc

SEQ ID NO: 569066 - DNA, 516 bp, Homo sapiens; identical to SEQ ID NO: 545737
  misc_feature: HIJSMM301AKB82.17.33.C11.1.454.light.4.raw

SEQ ID NO: 569067 - DNA, 506 bp, Homo sapiens
  misc_feature: HIJSMM301DD8QW.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccaggaggggagtgaatggaggggtgcagagaactccatggctaccaggtcagcccaaggcccaacccactgtcactctcgttcccgccctcctcta

SEQ ID NO: 569068 - DNA, 493 bp, Homo sapiens; identical to SEQ ID NO: 565379
  misc_feature: HIJSMM301C34O1.52.42.D09.1.454.light.4.raw

SEQ ID NO: 569069 - DNA, 486 bp, Homo sapiens; identical to SEQ ID NO: 535385
  misc_feature: HIJSMM301ETRCT.19.71.G05.1.454.light.4.raw

SEQ ID NO: 569070 - DNA, 485 bp, Homo sapiens; identical to SEQ ID NO: 542735
  misc_feature: HIJSMM301DDZ6L.26.45.E01.1.454.light.4.raw

SEQ ID NO: 569071 - DNA, 497 bp, Homo sapiens
  misc_feature: HIJSMM301A0762.3.37.D04.1.454.light.4.raw
agacgcactccacgaccggtgctcgatttagtagcatactgttgggtttgggggatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttattactgcgtgcaagttcgacaaaccccattcactttcgccctggaccaaagtggacatcaaacgaactgtggctgcaccatctgt

SEQ ID NO: 569072 - DNA, 513 bp, Homo sapiens
  misc_feature: HIJSMM301AZUDD.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 569073 - DNA, 508 bp, Homo sapiens
  misc_feature: HIJSMM301CQ1UU.9.43.D10.1.454.light.4.raw
tgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccaccctcctc

SEQ ID NO: 569074 - DNA, 514 bp, Homo sapiens
  misc_feature: HIJSMM301BQSYI.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtccactctgttcccgccctt

SEQ ID NO: 569075 - DNA, 490 bp, Homo sapiens
  misc_feature: HIJSMM301AQBIO.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcacctttcggcggagggaccgaaggtggagatcaagcgaactgtggctgcaccat

SEQ ID NO: 569076 - DNA, 496 bp, Homo sapiens; identical to SEQ ID NO: 536063
  misc_feature: HIJSMM301EI3YQ.5.49.E05.1.454.light.4.raw

SEQ ID NO: 569077 - DNA, 515 bp, Homo sapiens; identical to SEQ ID NO: 556682
  misc_feature: HIJSMM301DESOP.40.12.B01.1.454.light.4.raw

SEQ ID NO: 569078 - DNA, 490 bp, Homo sapiens; identical to SEQ ID NO: 535234
  misc_feature: HIJSMM301D9N61.17.21.B10.1.454.light.4.raw

SEQ ID NO: 569079 - DNA, 492 bp, Homo sapiens; identical to SEQ ID NO: 537666
  misc_feature: HIJSMM301D7XJI.43.33.C11.1.454.light.4.raw

SEQ ID NO: 569080 - DNA, 492 bp, Homo sapiens
  misc_feature: HIJSMM301CQDUX.49.35.D02.1.454.light.4.raw
agtcgagagacacgaccggtgctcgatttagcacacgatagttgggtttgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccgggacactttcggcggagggaccaagggtggaggatcaaacgaactgtggctgcacat

SEQ ID NO: 569081 - DNA, 444 bp, Homo sapiens
  misc_feature: HIJSMM301BZ0MD.4.39.D06.1.454.light.4.raw
agcactgtagcacgaccggtgctcgatttagtgacatctcgcagttctttggggcttctcctggtctctggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggagggtcccaccaacattcagcggcagtggatctgggacagagttcactctaaccatcagcagcctgcagcctgatgatcttggaacttatttctgccagcaaatataatagttattggacgttcggccaggggaccaaggtcgaaatgagacgaactgtggctgcaccatctgtcttcatcttcccgccatctgactacagtgct

SEQ ID NO: 569082 - DNA, 494 bp, Homo sapiens
  misc_feature: HIJSMM301B4F9A.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtacaaacgaactacgtggctgcacca

SEQ ID NO: 569083 - DNA, 491 bp, Homo sapiens
  misc_feature: HIJSMM301BBWO9.49.80.H03.1.454.light.4.raw
agtcgagagacacgaccggtgctcgatttagctgtgcgtcgaaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcactctgttcccaccct

SEQ ID NO: 569084 - DNA, 488 bp, Homo sapiens
  misc_feature: HIJSMM301BMLCA.43.36.D03.1.454.light.4.raw
tgtgagtagtcacgaccggtgctcgatttagctgcgtcacgagtctctcttgggggctacaacaggcaggcaggggcagcaagaatggtgttgcagacccaggtcttcatttctctgttgctctggatctctggtgccgttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaaggttggagatcaaacgaa

SEQ ID NO: 569085 - DNA, 510 bp, Homo sapiens
  misc_feature: HIJSMM301BTUNB.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggtccaagggaccgaaggtggaaagtacaaacgaacctagtggctgcaccatctgtcttcatcttccccg

SEQ ID NO: 569086 - DNA, 468 bp, Homo sapiens
  misc_feature: HIJSMM301EDR1G.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagattttcactctcaccatcagcagcctgcagcctgaagatgttgcaacttattactgtcaaaagaatagcgctgccccgctcagtttcggcggagggacccgaaggtggagatac

SEQ ID NO: 569087 - DNA, 507 bp, Homo sapiens
  misc_feature: HIJSMM301EQQTX.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaaggtttccaaccgggactctggggtcccagacagattcagcggcagtgggtcaggcactgatttcacactggaaatcagcagggtggagggctgaggatgttggggtttattactgcatgcaaactacacacggccgctcactttcggcggagggaccaaggtggagatcaaacgaactgtggctgcaccatctgt

SEQ ID NO: 569088 - DNA, 490 bp, Homo sapiens; identical to SEQ ID NO: 540941
  misc_feature: HIJSMM301DHJ56.16.72.G06.1.454.light.4.raw

SEQ ID NO: 569089 - DNA, 497 bp, Homo sapiens; identical to SEQ ID NO: 535740
  misc_feature: HIJSMM301BBUBQ.3.71.G05.1.454.light.4.raw

SEQ ID NO: 569090 - DNA, 434 bp, Homo sapiens; identical to SEQ ID NO: 560697
  misc_feature: HIJSMM301EB8BN.41.8.A08.1.454.light.4.raw

SEQ ID NO: 569091 - DNA, 478 bp, Homo sapiens; identical to SEQ ID NO: 555324
  misc_feature: HIJSMM301DSTAH.13.59.F04.1.454.light.4.raw

SEQ ID NO: 569092 - DNA, 484 bp, Homo sapiens
  misc_feature: HIJSMM301B0IM7.5.34.D01.1.454.light.4.raw
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgactggagattaacgaactagtggctgcaccta

SEQ ID NO: 569093 - DNA, 478 bp, Homo sapiens; identical to SEQ ID NO: 535129
  misc_feature: HIJSMM301EM6ZL.11.11.A11.1.454.light.4.raw

SEQ ID NO: 569094 - DNA, 455 bp, Homo sapiens; identical to SEQ ID NO: 555402
  misc_feature: HIJSMM301D5FE3.5.86.H09.1.454.light.4.raw

SEQ ID NO: 569095 - DNA, 497 bp, Homo sapiens
  misc_feature: HIJSMM301A7Z6N.40.38.D05.1.454.light.4.raw
tctagcgactcacgaccggtgctcgatttagtatctgatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggcc

SEQ ID NO: 569096 - DNA, 484 bp, Homo sapiens; identical to SEQ ID NO: 541334
  misc_feature: HIJSMM301BEMIH.19.71.G05.1.454.light.4.raw

SEQ ID NO: 569097 - DNA, 519 bp, Homo sapiens
  misc_feature: HIJSMM301AS198.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactattctgtcaagtgtgggacaccaacacttgtgtcttcgggactgggaccgaggtcaccgtcctaagtcagcccagggcccaaccccactgtcactctgttcccaccctccctcgacacg

SEQ ID NO: 569098 - DNA, 509 bp, Homo sapiens
  misc_feature: HIJSMM301DWKHK.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctaccaggctgaggacgaggctgattattactgcagcttatatacaggcaacaatacttttgtcttcggaactgggaccaaggtcaccgtcctaggtcagcccaaggccacccactgtcactctcg

SEQ ID NO: 569099 - DNA, 502 bp, Homo sapiens; identical to SEQ ID NO: 559615
  misc_feature: HIJSMM301CZKGV.21.81.H04.1.454.light.4.raw

SEQ ID NO: 569100 - DNA, 503 bp, Homo sapiens; identical to SEQ ID NO: 537970
  misc_feature: HIJSMM301CCV3Y.10.39.D06.1.454.light.4.raw

SEQ ID NO: 569101 - DNA, 491 bp, Homo sapiens; identical to SEQ ID NO: 535176
  misc_feature: HIJSMM301AV7PI.13.39.D06.1.454.light.4.raw

SEQ ID NO: 569102 - DNA, 483 bp, Homo sapiens; identical to SEQ ID NO: 535317
  misc_feature: HIJSMM301DRCEL.4.1.A01.1.454.light.4.raw

SEQ ID NO: 569103 - DNA, 486 bp, Homo sapiens; identical to SEQ ID NO: 535043
  misc_feature: HIJSMM301ASAP8.46.35.D02.1.454.light.4.raw

SEQ ID NO: 569104 - DNA, 504 bp, Homo sapiens
  misc_feature: HIJSMM301C1JFG.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccagggaccgacacgtagaatagagacgaactagtggctgcaccatctgtcttctatcttcccgt

SEQ ID NO: 569105 - DNA, 484 bp, Homo sapiens
  misc_feature: HIJSMM301D090N.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagcccaggttcagtggcagtgcgtctgcgacagagttcactctcaccatcaacagcctgcagtctgaagattttgcagtttattactgtcagcagtatcatgactggccgctcaccttcggccaagggcacgactggagattaaacgaactgtggctgcaccat

SEQ ID NO: 569106 - DNA, 490 bp, Homo sapiens
  misc_feature: HIJSMM301DDHA0.51.55.E11.1.454.light.4.raw
cgatcgtatacacgaccggtgctcgatttagcactcgcacgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggt

SEQ ID NO: 569107 - DNA, 482 bp, Homo sapiens; identical to SEQ ID NO: 541033
  misc_feature: HIJSMM301BN6MM.4.27.C05.1.454.light.4.raw

SEQ ID NO: 569108 - DNA, 496 bp, Homo sapiens; identical to SEQ ID NO: 547649
  misc_feature: HIJSMM301AY7CH.43.61.F06.1.454.light.4.raw

SEQ ID NO: 569109 - DNA, 475 bp, Homo sapiens
  misc_feature: HIJSMM301CFY7L.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctcggactgaagtgcatatgaagagaactgtggctgca

SEQ ID NO: 569110 - DNA, 498 bp, Homo sapiens; identical to SEQ ID NO: 537020
  misc_feature: HIJSMM301BZTIS.26.26.C04.1.454.light.4.raw

SEQ ID NO: 569111 - DNA, 487 bp, Homo sapiens; identical to SEQ ID NO: 536536
  misc_feature: HIJSMM301EPRBV.26.45.E01.1.454.light.4.raw

SEQ ID NO: 569112 - DNA, 477 bp, Homo sapiens
  misc_feature: HIJSMM301A0J89.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccccttgggaccatagtggatatcaaacgaacctgtggctgcaccatctgtcttcatcttccgccat

SEQ ID NO: 569113 - DNA, 497 bp, Homo sapiens
  misc_feature: HIJSMM301DI0XO.48.67.G01.1.454.light.4.raw
agtatacatacacgaccggtgctcgatttagagtatacatattgggtttggggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccg

SEQ ID NO: 569114 - DNA, 505 bp, Homo sapiens; identical to SEQ ID NO: 535503
  misc_feature: HIJSMM301AEBVZ.8.28.C06.1.454.light.4.raw

SEQ ID NO: 569115 - DNA, 491 bp, Homo sapiens
  misc_feature: HIJSMM301D8OD3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccccctcactttcggcggagggaccgaaggcggagatcagacgaactgtggctgcaccatctgtcttcta

SEQ ID NO: 569116 - DNA, 506 bp, Homo sapiens
  misc_feature: HIJSMM301BFUDU.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaggccaaccca

SEQ ID NO: 569117 - DNA, 486 bp, Homo sapiens; identical to SEQ ID NO: 535043
  misc_feature: HIJSMM301AIA0C.46.35.D02.1.454.light.4.raw

SEQ ID NO: 569118 - DNA, 517 bp, Homo sapiens
  misc_feature: HIJSMM301DUXQV.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccgacgggaccgacgacgtagaaatagagacgaaactagtggcgtgtcgaccactcctgtcttctactcttcccgt

SEQ ID NO: 569119 - DNA, 482 bp, Homo sapiens; identical to SEQ ID NO: 535920
  misc_feature: HIJSMM301B9PKW.19.71.G05.1.454.light.4.raw

SEQ ID NO: 569120 - DNA, 493 bp, Homo sapiens
  misc_feature: HIJSMM301EV6CJ.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtct

SEQ ID NO: 569121 - DNA, 499 bp, Homo sapiens
  misc_feature: HIJSMM301EB1FX.41.45.E01.1.454.light.4.raw
tctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcggtcactctcg

SEQ ID NO: 569122 - DNA, 486 bp, Homo sapiens; identical to SEQ ID NO: 535043
  misc_feature: HIJSMM301DXE6R.46.35.D02.1.454.light.4.raw

SEQ ID NO: 569123 - DNA, 540 bp, Homo sapiens
  misc_feature: HIJSMM301DJNBW.14.57.F02.1.454.light.4.raw
cgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgcccat

SEQ ID NO: 569124 - DNA, 481 bp, Homo sapiens
  misc_feature: HIJSMM301ENHZ6.8.5.A05.1.454.light.4.raw
ctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttggtacctacagggtatactggtaccaacagaagccagggagtcctccccagaatctcctggtatacaaatcagactcagataggcagcaggcctctggagtccccagccgcttctctggatccaaagatgcttcggccaatgcagggattttactcatctctgggctccagagtgacgatgaggctgactattactgtatgatttggcacaacagcgcttgggtgttcggcggagggaccaagctgaccctcctaggtca

SEQ ID NO: 569125 - DNA, 520 bp, Homo sapiens
  misc_feature: HIJSMM301EIBMO.27.23.C01.1.454.light.4.raw
  modified_base (505)..(505): a, c, t, g, unknown or other
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcgtcnctctcgtcccnccct

SEQ ID NO: 569126 - DNA, 512 bp, Homo sapiens; identical to SEQ ID NO: 562782
  misc_feature: HIJSMM301A0LPH.7.34.D01.1.454.light.4.raw

SEQ ID NO: 569127 - DNA, 504 bp, Homo sapiens; identical to SEQ ID NO: 538940
  misc_feature: HIJSMM301CYSEQ.2.35.D02.1.454.light.4.raw

SEQ ID NO: 569128 - DNA, 495 bp, Homo sapiens; identical to SEQ ID NO: 557377
  misc_feature: HIJSMM301ARXBA.41.53.E09.1.454.light.4.raw

SEQ ID NO: 569129 - DNA, 486 bp, Homo sapiens; identical to SEQ ID NO: 537428
  misc_feature: HIJSMM301A7VD6.47.62.F07.1.454.light.4.raw

SEQ ID NO: 569130 - DNA, 500 bp, Homo sapiens; identical to SEQ ID NO: 547703
  misc_feature: HIJSMM301BR328.43.34.D01.1.454.light.4.raw

SEQ ID NO: 569131 - DNA, 504 bp, Homo sapiens
  misc_feature: HIJSMM301DFOMU.51.38.D05.1.454.light.4.raw
cgatcgtatacacgaccggtgctcgatttagtatctgatagttgggtttgggcacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggacc

SEQ ID NO: 569132 - DNA, 502 bp, Homo sapiens; identical to SEQ ID NO: 537816
  misc_feature: HIJSMM301CIJI9.19.78.H01.1.454.light.4.raw

SEQ ID NO: 569133 - DNA, 479 bp, Homo sapiens
  misc_feature: HIJSMM301CHJDE.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggccccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 569134 - DNA, 497 bp, Homo sapiens
  misc_feature: HIJSMM301EZDW5.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaactgt

SEQ ID NO: 569135 - DNA, 494 bp, Homo sapiens; identical to SEQ ID NO: 536974
  misc_feature: HIJSMM301BB7GJ.16.86.H09.1.454.light.4.raw

SEQ ID NO: 569136 - DNA, 510 bp, Homo sapiens
  misc_feature: HIJSMM301AV9WG.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtggaaataaaacgaactgtggctgcaccatctgtcttcta

SEQ ID NO: 569137 - DNA, 514 bp, Homo sapiens
  misc_feature: HIJSMM301B99BH.49.59.F04.1.454.light.4.raw
agtcgagagacacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcg

SEQ ID NO: 569138 - DNA, 507 bp, Homo sapiens
  misc_feature: HIJSMM301BD7EE.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgagggcggatttattactgttgctcatatgcgggtagtagcactttcgatgtcctattcggcggagggaccgaagctgaccgtcctgggtcagcccaaggctcgcccctcgtcactctgttcccaccctcctctacgtcgtat

SEQ ID NO: 569139 - DNA, 503 bp, Homo sapiens; identical to SEQ ID NO: 551630
  misc_feature: HIJSMM301BV6J8.5.86.H09.1.454.light.4.raw

SEQ ID NO: 569140 - DNA, 502 bp, Homo sapiens
  misc_feature: HIJSMM301A818V.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgtcgccgaaggaccgaaggtggaaatacaaacgaactagtggcgtgcaccactctgtcttcatcttccccg

SEQ ID NO: 569141 - DNA, 506 bp, Homo sapiens; identical to SEQ ID NO: 542696
  misc_feature: HIJSMM301APMVK.7.71.G05.1.454.light.4.raw

SEQ ID NO: 569142 - DNA, 497 bp, Homo sapiens
  misc_feature: HIJSMM301A8AUB.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggccaaggtggaaatcaaacgaactgtggctgcacc

SEQ ID NO: 569143 - DNA, 501 bp, Homo sapiens
  misc_feature: HIJSMM301BOO4V.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccc

SEQ ID NO: 569144 - DNA, 486 bp, Homo sapiens
  misc_feature: HIJSMM301BB4K0.21.4.A04.1.454.light.4.raw
tcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcgaccaagggaccaaggtagaaatgaaacgaactgtgctgcaccat

SEQ ID NO: 569145 - DNA, 508 bp, Homo sapiens; identical to SEQ ID NO: 550380
  misc_feature: HIJSMM301CYZM3.4.57.F02.1.454.light.4.raw

SEQ ID NO: 569146 - DNA, 495 bp, Homo sapiens; identical to SEQ ID NO: 535486
  misc_feature: HIJSMM301A8ANR.26.72.G06.1.454.light.4.raw

SEQ ID NO: 569147 - DNA, 496 bp, Homo sapiens
  misc_feature: HIJSMM301B0N7N.40.23.C01.1.454.light.4.raw
  modified_base (464)..(464): a, c, t, g, unknown or other
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatnaaacgaactgtggctgcaccatctgtcttcat

SEQ ID NO: 569148 - DNA, 501 bp, Homo sapiens
  misc_feature: HIJSMM301BW33Q.47.64.F09.1.454.light.4.raw
  modified_base (482)..(482): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagacttttggactttattactgtcagcagcgtgagttctggcctccgctcacttcggtcggagggaccgagggtggagatacaaacgaaacagttggcgtncgaccatctgtcttctaat

SEQ ID NO: 569149 - DNA, 511 bp, Homo sapiens; identical to SEQ ID NO: 564989
  misc_feature: HIJSMM301DS3YF.48.14.B03.1.454.light.4.raw

SEQ ID NO: 569150 - DNA, 520 bp, Homo sapiens
  misc_feature: HIJSMM301DXZCB.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacctt

SEQ ID NO: 569151 - DNA, 494 bp, Homo sapiens; identical to SEQ ID NO: 553467
  misc_feature: HIJSMM301BGSL4.13.67.G01.1.454.light.4.raw

SEQ ID NO: 569152 - DNA, 502 bp, Homo sapiens; identical to SEQ ID NO: 536253
  misc_feature: HIJSMM301ET7R0.21.22.B11.1.454.light.4.raw

SEQ ID NO: 569153 - DNA, 475 bp, Homo sapiens; identical to SEQ ID NO: 562103
  misc_feature: HIJSMM301EEJKU.13.76.G10.1.454.light.4.raw

SEQ ID NO: 569154 - DNA, 494 bp, Homo sapiens; identical to SEQ ID NO: 534992
  misc_feature: HIJSMM301C3L9C.9.1.A01.1.454.light.4.raw

SEQ ID NO: 569155 - DNA, 485 bp, Homo sapiens
  misc_feature: HIJSMM301B7YDW.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtgtcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 569156 - DNA, 447 bp, Homo sapiens; identical to SEQ ID NO: 535020
  misc_feature: HIJSMM301A1B3W.18.9.A09.1.454.light.4.raw

SEQ ID NO: 569157 - DNA, 501 bp, Homo sapiens; identical to SEQ ID NO: 536867
  misc_feature: HIJSMM301EP0OA.5.86.H09.1.454.light.4.raw

SEQ ID NO: 569158 - DNA, 495 bp, Homo sapiens
  misc_feature: HIJSMM301CZMJB.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatacaacgaactgtggctgcaccatctgtcttcatt

SEQ ID NO: 569159 - DNA, 480 bp, Homo sapiens
  misc_feature: HIJSMM301BEPB8.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctgattattactgctgctcatatgcaggcagctacacttgggtgttcggcggagggaccaagctgaccgtcctaggtcacg

SEQ ID NO: 569160 - DNA, 487 bp, Homo sapiens; identical to SEQ ID NO: 536206
  misc_feature: HIJSMM301ES6F8.47.38.D05.1.454.light.4.raw

SEQ ID NO: 569161 - DNA, 503 bp, Homo sapiens
  misc_feature: HIJSMM301CH64X.40.53.E09.1.454.light.4.raw
tctagcgactcacgaccggtgctcgatttagagagagtgtgttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctcggccatcagtgggctccagtctgaggatgaggctgattatcactgtgcatcctgggatgacagcctgaatggttgggtgttcggcggggggaccgaaggctgaccgtcctaagtcagcccaac

SEQ ID NO: 569162 - DNA, 503 bp, Homo sapiens; identical to SEQ ID NO: 540163
  misc_feature: HIJSMM301AI1HG.10.7.A07.1.454.light.4.raw

SEQ ID NO: 569163 - DNA, 489 bp, Homo sapiens; identical to SEQ ID NO: 535139
  misc_feature: HIJSMM301CU0OW.14.55.E11.1.454.light.4.raw

SEQ ID NO: 569164 - DNA, 488 bp, Homo sapiens; identical to SEQ ID NO: 535990
  misc_feature: HIJSMM301EOE2U.11.28.C06.1.454.light.4.raw

SEQ ID NO: 569165 - DNA, 459 bp, Homo sapiens
  misc_feature: HIJSMM301B2NXE.5.36.D03.1.454.light.4.raw
atcagacacgcacgaccggtgctcgatttagctgcgtcacgatctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtgatctgggacagagttcactctcaccatcagcagcctgcagcctgacgatgtggcaacttattactgccaacagta

SEQ ID NO: 569166 - DNA, 493 bp, Homo sapiens; identical to SEQ ID NO: 536769
  misc_feature: HIJSMM301BEH1F.19.83.H06.1.454.light.4.raw

SEQ ID NO: 569167 - DNA, 509 bp, Homo sapiens
  misc_feature: HIJSMM301CMBIW.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtccagcccaaggcctgtccccccg

SEQ ID NO: 569168 - DNA, 494 bp, Homo sapiens; identical to SEQ ID NO: 534992
  misc_feature: HIJSMM301EKLHX.9.1.A01.1.454.light.4.raw

SEQ ID NO: 569169 - DNA, 493 bp, Homo sapiens; identical to SEQ ID NO: 537239
  misc_feature: HIJSMM301DZRZ7.49.66.F11.1.454.light.4.raw

SEQ ID NO: 569170 - DNA, 484 bp, Homo sapiens; identical to SEQ ID NO: 535240
  misc_feature: HIJSMM301D8LLL.47.60.F05.1.454.light.4.raw

SEQ ID NO: 569171 - DNA, 515 bp, Homo sapiens
  misc_feature: HIJSMM301DUZ5U.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaagtggcaatcaaccgaactgtgctgcaccatctgtcttcatcttccccg

SEQ ID NO: 569172 - DNA, 506 bp, Homo sapiens
  misc_feature: HIJSMM301B71QC.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcactc

SEQ ID NO: 569173 - DNA, 518 bp, Homo sapiens
  misc_feature: HIJSMM301CS8UE.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagtcaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccgaagggaccaaggtggcaatcaaccgaactgtggctgcaccatctgtcttcatcttccccg

SEQ ID NO: 569174 - DNA, 481 bp, Homo sapiens
  misc_feature: HIJSMM301DHENK.48.81.H04.1.454.light.4.raw
agtatacatacacgaccggtgctcgatttagtagtgtagattcgcgggggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccatctgtcttcatcttcccgccat

SEQ ID NO: 569175 - DNA, 500 bp, Homo sapiens; identical to SEQ ID NO: 547405
  misc_feature: HIJSMM301BUVPN.41.71.G05.1.454.light.4.raw

SEQ ID NO: 569176 - DNA, 484 bp, Homo sapiens
  misc_feature: HIJSMM301EDH4A.46.26.C04.1.454.light.4.raw
  modified_base (444)..(444): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccnctcactttcggcggagggaccaaggtggagatcaaacgaa

SEQ ID NO: 569177 - DNA, 496 bp, Homo sapiens; identical to SEQ ID NO: 535109
  misc_feature: HIJSMM301B3VKH.16.78.H01.1.454.light.4.raw

SEQ ID NO: 569178 - DNA, 500 bp, Homo sapiens
  misc_feature: HIJSMM301APVK4.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccacgactgaccgtcctaggtcagcccaaggctgcccctcggtcactctgttcccaccctcctccactactatg

SEQ ID NO: 569179 - DNA, 502 bp, Homo sapiens; identical to SEQ ID NO: 536253
  misc_feature: HIJSMM301ESG9K.21.22.B11.1.454.light.4.raw

SEQ ID NO: 569180 - DNA, 494 bp, Homo sapiens; identical to SEQ ID NO: 534992
  misc_feature: HIJSMM301BS13I.9.1.A01.1.454.light.4.raw

SEQ ID NO: 569181 - DNA, 505 bp, Homo sapiens; identical to SEQ ID NO: 541350
  misc_feature: HIJSMM301AKRVL.2.71.G05.1.454.light.4.raw

SEQ ID NO: 569182 - DNA, 520 bp, Homo sapiens; identical to SEQ ID NO: 535773
  misc_feature: HIJSMM301D7Z22.41.19.B08.1.454.light.4.raw

SEQ ID NO: 569183 - DNA, 487 bp, Homo sapiens; identical to SEQ ID NO: 536163
  misc_feature: HIJSMM301AIOLV.5.48.E04.1.454.light.4.raw

SEQ ID NO: 569184 - DNA, 524 bp, Homo sapiens
  misc_feature: HIJSMM301AJ7MU.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaacttggcgtcgtcaccactctcgttcttctactcttcccgtcccgactacttcg

SEQ ID NO: 569185 - DNA, 460 bp, Homo sapiens
  misc_feature: HIJSMM301DU9O1.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccagggctgaccgtcctaggtcagcccaaggctgcccctcggtcactctgttcccgccctcctcacgcgtatgt

SEQ ID NO: 569186 - DNA, 514 bp, Homo sapiens
  misc_feature: HIJSMM301BWLPZ.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcacttcc

SEQ ID NO: 569187 - DNA, 513 bp, Homo sapiens
  misc_feature: HIJSMM301CJ8FJ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagccaaggctgccccctcggtcactctgttcccgccctcctcgagtagtaca

SEQ ID NO: 569188 - DNA, 486 bp, Homo sapiens
  misc_feature: HIJSMM301B7XYB.40.86.H09.1.454.light.4.raw
tctagcgactcacgaccggtgctcgatttagtgctatagacttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 569189 - DNA, 491 bp, Homo sapiens; identical to SEQ ID NO: 535194
  misc_feature: HIJSMM301DKRDY.26.78.H01.1.454.light.4.raw

SEQ ID NO: 569190 - DNA, 499 bp, Homo sapiens; identical to SEQ ID NO: 536209
  misc_feature: HIJSMM301A3YYB.26.26.C04.1.454.light.4.raw

SEQ ID NO: 569191 - DNA, 509 bp, Homo sapiens
  misc_feature: HIJSMM301A3VZH.8.21.B10.1.454.light.4.raw
ctcgcgtgtccacgaccggtgctcgatttagtgtcgtcgcaaggagagaggggggagtcagtctcagtcaggacacagccatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtcttatactgcatccactttggcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggaggatcaaacgaactgtggctagcaccatctgtcttcatcttctcgcc

SEQ ID NO: 569192 - DNA, 447 bp, Homo sapiens; identical to SEQ ID NO: 535201
  misc_feature: HIJSMM301ASL02.18.9.A09.1.454.light.4.raw

SEQ ID NO: 569193 - DNA, 500 bp, Homo sapiens; identical to SEQ ID NO: 542669
  misc_feature: HIJSMM301CSKP7.18.11.A11.1.454.light.4.raw

SEQ ID NO: 569194 - DNA, 500 bp, Homo sapiens
  misc_feature: HIJSMM301ENZEY.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccatgtca

SEQ ID NO: 569195 - DNA, 484 bp, Homo sapiens; identical to SEQ ID NO: 540581
  misc_feature: HIJSMM301A08T8.3.88.H11.1.454.light.4.raw

SEQ ID NO: 569196 - DNA, 504 bp, Homo sapiens
  misc_feature: HIJSMM301B4UZJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaatacaaacgaactgtggctgcaccatctgtcttcatcttccccg

SEQ ID NO: 569197 - DNA, 506 bp, Homo sapiens; identical to SEQ ID NO: 557726
  misc_feature: HIJSMM301AVGPZ.47.83.H06.1.454.light.4.raw

SEQ ID NO: 569198 - DNA, 444 bp, Homo sapiens; identical to SEQ ID NO: 534993
  misc_feature: HIJSMM301DK1WX.5.9.A09.1.454.light.4.raw

SEQ ID NO: 569199 - DNA, 484 bp, Homo sapiens; identical to SEQ ID NO: 535400
  misc_feature: HIJSMM301BLCY2.46.26.C04.1.454.light.4.raw

SEQ ID NO: 569200 - DNA, 497 bp, Homo sapiens; identical to SEQ ID NO: 560060
  misc_feature: HIJSMM301B8BQM.22.86.H09.1.454.light.4.raw

SEQ ID NO: 569201 - DNA, 489 bp, Homo sapiens; identical to SEQ ID NO: 535139
  misc_feature: HIJSMM301B4M2J.14.55.E11.1.454.light.4.raw

SEQ ID NO: 569202 - DNA, 493 bp, Homo sapiens
  misc_feature: HIJSMM301BEPCQ.15.81.H04.1.454.light.4.raw
  modified_base (486)..(486): a, c, t, g, unknown or other
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaatcggccccaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgacctctaggtcagccaaggcncgccccc

SEQ ID NO: 569203 - DNA, 518 bp, Homo sapiens; identical to SEQ ID NO: 539372
  misc_feature: HIJSMM301BQEL0.7.86.H09.1.454.light.4.raw

SEQ ID NO: 569204 - DNA, 476 bp, Homo sapiens
  misc_feature: HIJSMM301BFDNM.51.76.G10.1.454.light.4.raw
cgatcgtatacacgaccggtgctcgatttagtcactcatacagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccagggcagtctccacaggtcctgatctatttgagttctaatcgggcccccgggtccctgacaggttcagtggcagtggatcaggctgaggatgttggggtttatcattgcatgcaagctctacaaactcctctagactttcggcggagggaccaaggtggagatcaagcgaactgtgctgcaccatctgtcttcatcttcccgccat

SEQ ID NO: 569205 - DNA, 504 bp, Homo sapiens; identical to SEQ ID NO: 549538
  misc_feature: HIJSMM301CIM1U.18.59.F04.1.454.light.4.raw

SEQ ID NO: 569206 - DNA, 504 bp, Homo sapiens
  misc_feature: HIJSMM301C4E9H.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatacaacgaactgtggctgcaccatctgtctt

SEQ ID NO: 569207 - DNA, 484 bp, Homo sapiens; identical to SEQ ID NO: 536393
  misc_feature: HIJSMM301DCSI3.4.41.D08.1.454.light.4.raw

SEQ ID NO: 569208 - DNA, 479 bp, Homo sapiens; identical to SEQ ID NO: 542895
  misc_feature: HIJSMM301ELOOE.40.59.F04.1.454.light.4.raw

SEQ ID NO: 569209 - DNA, 503 bp, Homo sapiens
  misc_feature: HIJSMM301BMGJ6.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccggtcctaggtcagcccaaggccaacccccta

SEQ ID NO: 569210 - DNA, 490 bp, Homo sapiens; identical to SEQ ID NO: 535526
  misc_feature: HIJSMM301EJH24.26.78.H01.1.454.light.4.raw

SEQ ID NO: 569211 - DNA, 489 bp, Homo sapiens; identical to SEQ ID NO: 544329
  misc_feature: HIJSMM301AIDHW.11.28.C06.1.454.light.4.raw

SEQ ID NO: 569212 - DNA, 504 bp, Homo sapiens
  misc_feature: HIJSMM301C4SJP.40.67.G01.1.454.light.4.raw
tctagcgactcacgaccggtgctcgatttagagtatacatattgggtttggggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttcccgccat

SEQ ID NO: 569213 - DNA, 494 bp, Homo sapiens; identical to SEQ ID NO: 550130
  misc_feature: HIJSMM301DRC5D.12.38.D05.1.454.light.4.raw

SEQ ID NO: 569214 - DNA, 482 bp, Homo sapiens; identical to SEQ ID NO: 535352
  misc_feature: HIJSMM301BQSRF.16.81.H04.1.454.light.4.raw

SEQ ID NO: 569215 - DNA, 444 bp, Homo sapiens; identical to SEQ ID NO: 535411
  misc_feature: HIJSMM301APXUS.8.73.G07.1.454.light.4.raw

SEQ ID NO: 569216 - DNA, 490 bp, Homo sapiens
  misc_feature: HIJSMM301EZAMA.5.48.E04.1.454.light.4.raw
atcagacacgcacgaccggtgctcgatttagagagcgtcacagagagaaggggagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgccatcta

SEQ ID NO: 569217 - DNA, 510 bp, Homo sapiens; identical to SEQ ID NO: 553826
  misc_feature: HIJSMM301DTSK8.13.73.G07.1.454.light.4.raw

SEQ ID NO: 569218 - DNA, 495 bp, Homo sapiens
  misc_feature: HIJSMM301A50XY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaaggaccgaaggtaggaagtcaaacgaactagtggcgtgcaccatctgtctt

SEQ ID NO: 569219 - DNA, 489 bp, Homo sapiens; identical to SEQ ID NO: 546315
  misc_feature: HIJSMM301BAH8Z.43.33.C11.1.454.light.4.raw

SEQ ID NO: 569220 - DNA, 503 bp, Homo sapiens
  misc_feature: HIJSMM301BXFZW.40.28.C06.1.454.light.4.raw
tctagcgactcacgaccggtgctcgatttagagctcacgtattgggtttggggagagaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtagcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatt

SEQ ID NO: 569221 - DNA, 485 bp, Homo sapiens
  misc_feature: HIJSMM301D01QW.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccagggaccgaacctggagat

SEQ ID NO: 569222 - DNA, 488 bp, Homo sapiens; identical to SEQ ID NO: 536742
  misc_feature: HIJSMM301B9FJA.3.72.G06.1.454.light.4.raw

SEQ ID NO: 569223 - DNA, 486 bp, Homo sapiens
  misc_feature: HIJSMM301C2WLP.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaagatattgcaacatattactgtcaacagtatcataatctccccatttcggccctgggaccaaagtggatatcaaacgaactgtggctgcaccatctgtt

SEQ ID NO: 569224 - DNA, 483 bp, Homo sapiens; identical to SEQ ID NO: 544010
  misc_feature: HIJSMM301BZAFN.19.5.A05.1.454.light.4.raw

SEQ ID NO: 569225 - DNA, 445 bp, Homo sapiens; identical to SEQ ID NO: 537719
  misc_feature: HIJSMM301BEZ81.47.85.H08.1.454.light.4.raw

SEQ ID NO: 569226 - DNA, 495 bp, Homo sapiens
  misc_feature: HIJSMM301DYQ9M.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgtgacatattactgtcaacagtatgaaaatgtcccgctcactttcggcgggggaccgaaggtggagttcaaacgaactgtggctgcaccatctgtcttcatt

SEQ ID NO: 569227 - DNA, 496 bp, Homo sapiens; identical to SEQ ID NO: 541772
  misc_feature: HIJSMM301AHOB6.51.81.H04.1.454.light.4.raw

SEQ ID NO: 569228 - DNA, 447 bp, Homo sapiens; identical to SEQ ID NO: 535020
  misc_feature: HIJSMM301DGEK1.18.9.A09.1.454.light.4.raw

SEQ ID NO: 569229 - DNA, 522 bp, Homo sapiens
  misc_feature: HIJSMM301EKS5R.27.23.C01.1.454.light.4.raw
agcgtcgtctcacgaccggtgctcgatttagtacacgtgattaggggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggcactctgttcccgccctt

SEQ ID NO: 569230 - DNA, 495 bp, Homo sapiens; identical to SEQ ID NO: 554164
  misc_feature: HIJSMM301A8VCW.27.78.H01.1.454.light.4.raw

SEQ ID NO: 569231 - DNA, 515 bp, Homo sapiens
  misc_feature: HIJSMM301B6EL5.15.34.D01.1.454.light.4.raw
tctacgtagccacgaccggtgctcgatttagatcgtctgtgttgggtttggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacaccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 569232 - DNA, 485 bp, Homo sapiens
  misc_feature: HIJSMM301AV4H9.49.27.C05.1.454.light.4.raw
agtcgagagacacgaccggtgctcgatttagacgcgatcgaagggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggc

SEQ ID NO: 569233 - DNA, 441 bp, Homo sapiens; identical to SEQ ID NO: 534971
  misc_feature: HIJSMM301DIRAX.11.3.A03.1.454.light.4.raw

SEQ ID NO: 569234 - DNA, 508 bp, Homo sapiens
  misc_feature: HIJSMM301AK99R.12.48.E04.1.454.light.4.raw
atacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggttcctgaccgattctctggctccaagtctggcacctcagcctccctggccatcagtgggctccagtctgaggatgaggctgattattactgtgcatcatgggctgacaccctgactggtccggagtgttcggcggagggaccaagctgaccgtcctaggtcagcccaaggcagccccctcggtcact

SEQ ID NO: 569235 - DNA, 514 bp, Homo sapiens
  misc_feature: HIJSMM301DVENY.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccacctcct

SEQ ID NO: 569236 - DNA, 509 bp, Homo sapiens
  misc_feature: HIJSMM301BJNX2.47.85.H08.1.454.light.4.raw
  modified_base (506)..(506): a, c, t, g, unknown or other
agctcacgtacacgaccggtgctcgatttagtatcactcagtcgcggggcgtgggtcgtcaagggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactctgtcgtttgggtgttcggcggagggaccaagttgaccgtcctaggtcagcccaggctcgccccctcggtcnctt

SEQ ID NO: 569237 - DNA, 447 bp, Homo sapiens; identical to SEQ ID NO: 535201
  misc_feature: HIJSMM301AMP11.18.9.A09.1.454.light.4.raw

SEQ ID NO: 569238 - DNA, 494 bp, Homo sapiens
  misc_feature: HIJSMM301BBETJ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgaactggagattaaacgaactgtggctgcaccatctgctt

SEQ ID NO: 569239 - DNA, 494 bp, Homo sapiens; identical to SEQ ID NO: 535478
  misc_feature: HIJSMM301EBSKL.10.79.H02.1.454.light.4.raw

SEQ ID NO: 569240 - DNA, 447 bp, Homo sapiens; identical to SEQ ID NO: 535201
  misc_feature: HIJSMM301B3957.18.9.A09.1.454.light.4.raw

SEQ ID NO: 569241 - DNA, 501 bp, Homo sapiens; identical to SEQ ID NO: 536867
  misc_feature: HIJSMM301BXJPK.5.86.H09.1.454.light.4.raw

SEQ ID NO: 569242 - DNA, 506 bp, Homo sapiens
  misc_feature: HIJSMM301BN29K.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtcccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 569243 - DNA, 444 bp, Homo sapiens; identical to SEQ ID NO: 535027
  misc_feature: HIJSMM301DVG81.8.73.G07.1.454.light.4.raw

SEQ ID NO: 569244 - DNA, 502 bp, Homo sapiens
  misc_feature: HIJSMM301C4316.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtc

SEQ ID NO: 569245 - DNA, 500 bp, Homo sapiens
  misc_feature: HIJSMM301EYAKZ.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 569246 - DNA, 354 bp, Homo sapiens; identical to SEQ ID NO: 535026
  misc_feature: HIJSMM301CRYLJ.19.22.B11.1.454.light.4.raw

SEQ ID NO: 569247 - DNA, 507 bp, Homo sapiens
  misc_feature: HIJSMM301ADJRH.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactagtggctgcaccatctgt

SEQ ID NO: 569248 - DNA, 503 bp, Homo sapiens; identical to SEQ ID NO: 538973
  misc_feature: HIJSMM301CBLZJ.5.86.H09.1.454.light.4.raw

SEQ ID NO: 569249 - DNA, 494 bp, Homo sapiens; identical to SEQ ID NO: 534992
  misc_feature: HIJSMM301D21GO.9.1.A01.1.454.light.4.raw

SEQ ID NO: 569250 - DNA, 523 bp, Homo sapiens
  misc_feature: HIJSMM301EG1Z2.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttcttgcagctcaaaagaagtagccctctcgtggttttcggcgggggaccaaggtgaccgtcctaagtcagccaaggctgccccctcggtcactctgttcccgccctcctcacg

SEQ ID NO: 569251 - DNA, 504 bp, Homo sapiens
  misc_feature: HIJSMM301AGP9B.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtttgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctc

SEQ ID NO: 569252 - DNA, 494 bp, Homo sapiens; identical to SEQ ID NO: 550275
  misc_feature: HIJSMM301BCLL7.11.59.F04.1.454.light.4.raw

SEQ ID NO: 569253 - DNA, 496 bp, Homo sapiens
  misc_feature: HIJSMM301A77ZJ.52.24.C02.1.454.light.4.raw
cgcagtacgacacgaccggtgctcgatttagtacagatcgttagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcact

SEQ ID NO: 569254 - DNA, 478 bp, Homo sapiens
  misc_feature: HIJSMM301DGYY8.48.34.D01.1.454.light.4.raw
agtatacatacacgaccggtgctcgatttagatcgtctgtgttgggtttgggggcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcgccatctgtcttcatcttcccgccatctgatatgtata

SEQ ID NO: 569255 - DNA, 448 bp, Homo sapiens
  misc_feature: HIJSMM301BHY2S.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 569256 - DNA, 493 bp, Homo sapiens; identical to SEQ ID NO: 535084
  misc_feature: HIJSMM301B0AV1.47.64.F09.1.454.light.4.raw

SEQ ID NO: 569257 - DNA, 502 bp, Homo sapiens
  misc_feature: HIJSMM301BQVTM.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgcccttactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaaccaaggtcaccgtcctaggtcagcccaaggccaa

SEQ ID NO: 569258 - DNA, 490 bp, Homo sapiens
  misc_feature: HIJSMM301BKWJB.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaaggaccaaggtggaaagtacaaacgaactagtggctgcaccat

SEQ ID NO: 569259 - DNA, 497 bp, Homo sapiens
  misc_feature: HIJSMM301AGHWL.48.31.C09.1.454.light.4.raw
agtatacatacacgaccggtgctcgatttagacgtctcatcaaggaaggaagggggcaggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgtcgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtctt

SEQ ID NO: 569260 - DNA, 521 bp, Homo sapiens
  misc_feature: HIJSMM301AED7J.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtgcgacgggacgacgacgagaatagagacgaactacgtggcgtcgtcgaccactactcgttcgttcctactacttccgttaccccg

SEQ ID NO: 569261 - DNA, 504 bp, Homo sapiens
  misc_feature: HIJSMM301BEQJO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgtgcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaaactgtggctgcaccatctgtcttcatcttcccgcc

SEQ ID NO: 569262 - DNA, 497 bp, Homo sapiens
  misc_feature: HIJSMM301D70T8.43.49.E05.1.454.light.4.raw
tgtgagtagtcacgaccggtgctcgatttagagcgactagcaacacacaaaggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccgaaggtggagatcaaacgaactgtggctgacacca

SEQ ID NO: 569263 - DNA, 522 bp, Homo sapiens; identical to SEQ ID NO: 543470
  misc_feature: HIJSMM301EX2ZI.5.27.C05.1.454.light.4.raw

SEQ ID NO: 569264 - DNA, 501 bp, Homo sapiens; identical to SEQ ID NO: 555551
  misc_feature: HIJSMM301EYFZC.21.81.H04.1.454.light.4.raw

SEQ ID NO: 569265 - DNA, 479 bp, Homo sapiens; identical to SEQ ID NO: 535531
  misc_feature: HIJSMM301DM04B.41.17.B06.1.454.light.4.raw

SEQ ID NO: 569266 - DNA, 492 bp, Homo sapiens; identical to SEQ ID NO: 535939
  misc_feature: HIJSMM301BQ94F.13.5.A05.1.454.light.4.raw

SEQ ID NO: 569267 - DNA, 518 bp, Homo sapiens
  misc_feature: HIJSMM301DZ2ZG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcgacggacgaacggtaggaaggtacgaacgaactagtggcgtgcgaccactctcgtcttctactcttcccgtcccactcct

SEQ ID NO: 569268 - DNA, 481 bp, Homo sapiens; identical to SEQ ID NO: 537385
  misc_feature: HIJSMM301B3YWL.52.4.A04.1.454.light.4.raw

SEQ ID NO: 569269 - DNA, 487 bp, Homo sapiens; identical to SEQ ID NO: 536206
  misc_feature: HIJSMM301D6CM2.47.38.D05.1.454.light.4.raw

SEQ ID NO: 569270 - DNA, 518 bp, Homo sapiens; identical to SEQ ID NO: 539372
  misc_feature: HIJSMM301CH45S.7.86.H09.1.454.light.4.raw

SEQ ID NO: 569271 - DNA, 480 bp, Homo sapiens
  misc_feature: HIJSMM301ASCKK.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacacagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 569272 - DNA, 508 bp, Homo sapiens
  misc_feature: HIJSMM301CLLA4.48.15.B04.1.454.light.4.raw
agtatacatacacgaccggtgctcgatttagacagtatatatccgcgggcacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaaggctgaccgtcct

SEQ ID NO: 569273 - DNA, 506 bp, Homo sapiens
  misc_feature: HIJSMM301EKWWH.48.47.E03.1.454.light.4.raw
agtatacatacacgaccggtgctcgatttagactcgcgcacagagagaagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggtcagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttccccg

SEQ ID NO: 569274 - DNA, 468 bp, Homo sapiens
  misc_feature: HIJSMM301B2DBM.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataaccc

SEQ ID NO: 569275 - DNA, 501 bp, Homo sapiens
  misc_feature: HIJSMM301DB1SJ.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccgggcagagggtcaccatttcttgttctggaacccactccaacatcggatataattctgtagactggtaccagcagcttccaggagccggccccccgactcctcatctttaataacaatcagcggccctcgaggggtccctgaccgattctctggctccaagtctggcacctcagcctccctggccatcagtgggctccagtctgaggatgaggctgattattactgtgcatcatgggctgacaccctgactggtccggagtgttcggcggagggaccaagctgaccgtctaggtcagcccaa

SEQ ID NO: 569276 - DNA, 497 bp, Homo sapiens; identical to SEQ ID NO: 545146
  misc_feature: HIJSMM301BG77C.43.25.C03.1.454.light.4.raw

SEQ ID NO: 569277 - DNA, 496 bp, Homo sapiens
  misc_feature: HIJSMM301EG2C4.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgttctttggaagtgggaccaaggtcaccgtccttggtcagcccagg

SEQ ID NO: 569278 - DNA, 352 bp, Homo sapiens; identical to SEQ ID NO: 542316
  misc_feature: HIJSMM301B0TDD.4.67.G01.1.454.light.4.raw

SEQ ID NO: 569279 - DNA, 486 bp, Homo sapiens; identical to SEQ ID NO: 543773
  misc_feature: HIJSMM301D1RU3.43.50.E06.1.454.light.4.raw

SEQ ID NO: 569280 - DNA, 535 bp, Homo sapiens
  misc_feature: HIJSMM301AJXSP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattaactgtcagcaatatggtacttcaccccggacgtcgcctacggaccgaacggtaggaagtacgaaacgaaactagtacggtcgtgcaccactactctcgttcctactacttcccgtccctacgtcctacgtac

SEQ ID NO: 569281 - DNA, 479 bp, Homo sapiens
  misc_feature: HIJSMM301B84Z3.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatctcactctcactgtcagcagtctgcaatttgaagtattttgcaacttactactgtcaacagagtttcagtatccctttggactttcggccaagggaccgaaggtggaaatcaaacgaactgt

SEQ ID NO: 569282 - DNA, 460 bp, Homo sapiens; identical to SEQ ID NO: 537107
  misc_feature: HIJSMM301DCSRG.22.28.C06.1.454.light.4.raw

SEQ ID NO: 569283 - DNA, 511 bp, Homo sapiens; identical to SEQ ID NO: 544123
  misc_feature: HIJSMM301AJXBE.5.27.C05.1.454.light.4.raw

SEQ ID NO: 569284 - DNA, 454 bp, Homo sapiens; identical to SEQ ID NO: 534964
  misc_feature: HIJSMM301CGPD8.19.86.H09.1.454.light.4.raw

SEQ ID NO: 569285 - DNA, 489 bp, Homo sapiens; identical to SEQ ID NO: 535091
  misc_feature: HIJSMM301AP5UO.47.36.D03.1.454.light.4.raw

SEQ ID NO: 569286 - DNA, 513 bp, Homo sapiens; identical to SEQ ID NO: 561323
  misc_feature: HIJSMM301ATWGT.43.19.B08.1.454.light.4.raw

SEQ ID NO: 569287 - DNA, 443 bp, Homo sapiens; identical to SEQ ID NO: 538732
  misc_feature: HIJSMM301D9MBP.9.9.A09.1.454.light.4.raw

SEQ ID NO: 569288 - DNA, 495 bp, Homo sapiens; identical to SEQ ID NO: 535007
  misc_feature: HIJSMM301DHNW0.22.5.A05.1.454.light.4.raw

SEQ ID NO: 569289 - DNA, 489 bp, Homo sapiens; identical to SEQ ID NO: 548452
  misc_feature: HIJSMM301EDRQM.26.37.D04.1.454.light.4.raw

SEQ ID NO: 569290 - DNA, 521 bp, Homo sapiens; identical to SEQ ID NO: 539470
  misc_feature: HIJSMM301B6SLA.27.23.C01.1.454.light.4.raw

SEQ ID NO: 569291 - DNA, 461 bp, Homo sapiens
  misc_feature: HIJSMM301BPFZ0.22.28.C06.1.454.light.4.raw
acatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactccctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgcccctcggtcactctgttcccaccctcctcacgcgtatgt

SEQ ID NO: 569292 - DNA, 493 bp, Homo sapiens
  misc_feature: HIJSMM301D701M.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctctactttcggcggagggaccagggtggagatcagacgaactgtggctgcacatctgtt

SEQ ID NO: 569293 - DNA, 502 bp, Homo sapiens; identical to SEQ ID NO: 564997
  misc_feature: HIJSMM301EQSLU.9.71.G05.1.454.light.4.raw

SEQ ID NO: 569294 - DNA, 486 bp, Homo sapiens
  misc_feature: HIJSMM301ESZXR.52.24.C02.1.454.light.4.raw
cgcagtacgacacgaccggtgctcgatttagtacagatcgttagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagatttttactttcaccatcagcagcctgcagcctgaggatattgcaacatattactgtcaacagtacgataatctcccgctcactttcggcgggggaccaaggtggagatcaaacgaactgtggctgcaccatctgtctt

SEQ ID NO: 569295 - DNA, 487 bp, Homo sapiens
  misc_feature: HIJSMM301DZDCR.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaaccgaacggtaggaagtcaaacgaactgtggctgcacc

SEQ ID NO: 569296 - DNA, 492 bp, Homo sapiens
  misc_feature: HIJSMM301ENPWP.51.12.B01.1.454.light.4.raw
cgatcgtatacacgaccggtgctcgatttagtagtgtagattccgcgggcacgaccggtgctcgatttagtgtcgtcgcaaggagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtactttatgtcttcggaactgcgacc

SEQ ID NO: 569297 - DNA, 504 bp, Homo sapiens; identical to SEQ ID NO: 539099
  misc_feature: HIJSMM301D8BH1.19.85.H08.1.454.light.4.raw

SEQ ID NO: 569298 - DNA, 494 bp, Homo sapiens
  misc_feature: HIJSMM301C1RTX.48.29.C07.1.454.light.4.raw
agtatacatacacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggcgttcgcacggaccgaaggtaggaatacaacgaactagtggctgcacca

SEQ ID NO: 569299 - DNA, 514 bp, Homo sapiens
  misc_feature: HIJSMM301EFU1Q.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaacggaccgaacggtaggaagtacaagacgaaccgtagtggcgtgcgaccactctgtcttctactcttcccgt

SEQ ID NO: 569300 - DNA, 445 bp, Homo sapiens; identical to SEQ ID NO: 542143
  misc_feature: HIJSMM301AOJQB.47.85.H08.1.454.light.4.raw

SEQ ID NO: 569301 - DNA, 518 bp, Homo sapiens; identical to SEQ ID NO: 561111
  misc_feature: HIJSMM301CAZKM.27.23.C01.1.454.light.4.raw

SEQ ID NO: 569302 - DNA, 502 bp, Homo sapiens
  misc_feature: HIJSMM301BTMBC.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctggtcagcccaaggctgccccctcggtca

SEQ ID NO: 569303 - DNA, 475 bp, Homo sapiens
  misc_feature: HIJSMM301BTPU6.13.76.G10.1.454.light.4.raw
  modified_base (428)..(428): a, c, t, g, unknown or other
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntatgtcttcggaactgggaccaaggtcaccgtctaagtcagaccccg

SEQ ID NO: 569304 - DNA, 481 bp, Homo sapiens; identical to SEQ ID NO: 539712
  misc_feature: HIJSMM301CJRBJ.51.60.F05.1.454.light.4.raw

SEQ ID NO: 569305 - DNA, 497 bp, Homo sapiens; identical to SEQ ID NO: 539058
  misc_feature: HIJSMM301ARCV9.12.87.H10.1.454.light.4.raw

SEQ ID NO: 569306 - DNA, 505 bp, Homo sapiens
  misc_feature: HIJSMM301BH1XS.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtnttcgggcggagggaccaaactggaccgtcctaggtcagccccaa

SEQ ID NO: 569307 - DNA, 470 bp, Homo sapiens; identical to SEQ ID NO: 535302
  misc_feature: HIJSMM301EG1NZ.13.76.G10.1.454.light.4.raw

SEQ ID NO: 569308 - DNA, 505 bp, Homo sapiens; identical to SEQ ID NO: 535503
  misc_feature: HIJSMM301B02TN.8.28.C06.1.454.light.4.raw

SEQ ID NO: 569309 - DNA, 447 bp, Homo sapiens; identical to SEQ ID NO: 535201
  misc_feature: HIJSMM301ERE4I.18.9.A09.1.454.light.4.raw

SEQ ID NO: 569310 - DNA, 494 bp, Homo sapiens; identical to SEQ ID NO: 534992
  misc_feature: HIJSMM301EACGY.9.1.A01.1.454.light.4.raw

SEQ ID NO: 569311 - DNA, 484 bp, Homo sapiens; identical to SEQ ID NO: 536395
  misc_feature: HIJSMM301BXOD9.46.35.D02.1.454.light.4.raw

SEQ ID NO: 569312 - DNA, 502 bp, Homo sapiens; identical to SEQ ID NO: 543172
  misc_feature: HIJSMM301B961Z.18.59.F04.1.454.light.4.raw

SEQ ID NO: 569313 - DNA, 485 bp, Homo sapiens; identical to SEQ ID NO: 535501
  misc_feature: HIJSMM301B7ROO.3.10.A10.1.454.light.4.raw

SEQ ID NO: 569314 - DNA, 447 bp, Homo sapiens; identical to SEQ ID NO: 535020
  misc_feature: HIJSMM301BELN1.18.9.A09.1.454.light.4.raw

SEQ ID NO: 569315 - DNA, 490 bp, Homo sapiens
  misc_feature: HIJSMM301DJY67.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatggttgggtttactactgcatgcaagctctacaagccacctacacttttggccgacggggaccaggctggagatcaaaacgaactagt

SEQ ID NO: 569316 - DNA, 484 bp, Homo sapiens; identical to SEQ ID NO: 535400
  misc_feature: HIJSMM301EK4MO.46.26.C04.1.454.light.4.raw

SEQ ID NO: 569317 - DNA, 445 bp, Homo sapiens
  misc_feature: HIJSMM301DZ388.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggcctgcccctcggtcactctgttcccaccctcctccgtgtctgat

SEQ ID NO: 569318 - DNA, 487 bp, Homo sapiens
  misc_feature: HIJSMM301A34PS.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgacaacttattactgtcaacagagtaacacgttacccctaccctactttcggcggagggaccgaaggtaggaggatacaaacgaactagtggctgca

SEQ ID NO: 569319 - DNA, 496 bp, Homo sapiens
  misc_feature: HIJSMM301EHWQ7.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctagtcagcccaaggctgccccctcggtcactctcg

SEQ ID NO: 569320 - DNA, 485 bp, Homo sapiens
  misc_feature: HIJSMM301D1I3H.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggaggaccaaggtggagatcaagcgaactgtggctgcaccat

SEQ ID NO: 569321 - DNA, 487 bp, Homo sapiens; identical to SEQ ID NO: 549649
  misc_feature: HIJSMM301CTE5I.19.71.G05.1.454.light.4.raw

SEQ ID NO: 569322 - DNA, 506 bp, Homo sapiens
  misc_feature: HIJSMM301B02J6.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcta

SEQ ID NO: 569323 - DNA, 524 bp, Homo sapiens
  misc_feature: HIJSMM301ATO72.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggtcggaggggaccaggctgaccgtcctaggtcagcccaaggctgccccctcggtcactctgttcccgccct

SEQ ID NO: 569324 - DNA, 444 bp, Homo sapiens; identical to SEQ ID NO: 535192
  misc_feature: HIJSMM301DAIID.5.9.A09.1.454.light.4.raw

SEQ ID NO: 569325 - DNA, 422 bp, Homo sapiens; identical to SEQ ID NO: 537797
  misc_feature: HIJSMM301CNWMN.9.34.D01.1.454.light.4.raw

SEQ ID NO: 569326 - DNA, 502 bp, Homo sapiens; identical to SEQ ID NO: 541971
  misc_feature: HIJSMM301AN1RP.4.39.D06.1.454.light.4.raw

SEQ ID NO: 569327 - DNA, 520 bp, Homo sapiens
  misc_feature: HIJSMM301EZ1A1.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctgactccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 569328 - DNA, 487 bp, Homo sapiens
  misc_feature: HIJSMM301CF4CL.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtgagggaccaaggtggaggtcaacgaactgtggctgcaccatctgtcttcat

SEQ ID NO: 569329 - DNA, 445 bp, Homo sapiens; identical to SEQ ID NO: 542143
  misc_feature: HIJSMM301BAMYN.47.85.H08.1.454.light.4.raw

SEQ ID NO: 569330 - DNA, 501 bp, Homo sapiens
  misc_feature: HIJSMM301B5UKE.48.35.D02.1.454.light.4.raw
agtatacatacacgaccggtgctcgatttagcacacgatagttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccta

SEQ ID NO: 569331 - DNA, 478 bp, Homo sapiens; identical to SEQ ID NO: 535129
  misc_feature: HIJSMM301CTSUX.11.11.A11.1.454.light.4.raw

SEQ ID NO: 569332 - DNA, 495 bp, Homo sapiens; identical to SEQ ID NO: 535596
  misc_feature: HIJSMM301C2DXS.10.79.H02.1.454.light.4.raw

SEQ ID NO: 569333 - DNA, 468 bp, Homo sapiens
  misc_feature: HIJSMM301D3O8Q.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcggggggaccaaggtggagatc

SEQ ID NO: 569334 - DNA, 488 bp, Homo sapiens
  misc_feature: HIJSMM301C1RZL.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcaggtgggtctgggacagacttcactctcaccatcagcagactggagcctgaagattttgcagtgtattactgtcagcagtatggtagctcacctcggacgttcggccgaaggaccgaaggtaggaatacaacgaactagtggcgtgcacc

SEQ ID NO: 569335 - DNA, 493 bp, Homo sapiens
  misc_feature: HIJSMM301C3D25.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggaggaccaagctgaccgtcctgggtcagcccaaggctgccccctcggtcact

SEQ ID NO: 569336 - DNA, 505 bp, Homo sapiens; identical to SEQ ID NO: 567186
  misc_feature: HIJSMM301AGGMN.9.71.G05.1.454.light.4.raw

SEQ ID NO: 569337 - DNA, 482 bp, Homo sapiens
  misc_feature: HIJSMM301BLG2G.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccactgagctacgt

SEQ ID NO: 569338 - DNA, 488 bp, Homo sapiens; identical to SEQ ID NO: 540827
  misc_feature: HIJSMM301BB45M.15.49.E05.1.454.light.4.raw

SEQ ID NO: 569339 - DNA, 550 bp, Homo sapiens
  misc_feature: HIJSMM301C1O6U.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtagggtaaggtacgtaaacgaaacgtacgtgggtcgtggcacccaactcttcgtctttcctattaccttccccggtccctactaccttcgt

SEQ ID NO: 569340 - DNA, 502 bp, Homo sapiens
  misc_feature: HIJSMM301CNM2A.5.24.C02.1.454.light.4.raw
atcagacacgcacgaccggtgctcgatttagtacagatcgttagggaaagggcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatcgtgatcttcgcc

SEQ ID NO: 569341 - DNA, 494 bp, Homo sapiens; identical to SEQ ID NO: 534992
  misc_feature: HIJSMM301AKV0X.9.1.A01.1.454.light.4.raw

SEQ ID NO: 569342 - DNA, 523 bp, Homo sapiens
  misc_feature: HIJSMM301BZAO7.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgtcctaggtcagcccaaggctgccccctcggtcactctgttcccaccct

SEQ ID NO: 569343 - DNA, 443 bp, Homo sapiens; identical to SEQ ID NO: 544913
  misc_feature: HIJSMM301B18QC.5.9.A09.1.454.light.4.raw

SEQ ID NO: 569344 - DNA, 486 bp, Homo sapiens; identical to SEQ ID NO: 537127
  misc_feature: HIJSMM301AVZ6N.3.77.G11.1.454.light.4.raw

SEQ ID NO: 569345 - DNA, 511 bp, Homo sapiens
  misc_feature: HIJSMM301CZLSY.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggtgggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctga

SEQ ID NO: 569346 - DNA, 498 bp, Homo sapiens
  misc_feature: HIJSMM301AT1GS.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaagctcgccccctcggt

SEQ ID NO: 569347 - DNA, 490 bp, Homo sapiens
  misc_feature: HIJSMM301CR8HC.48.34.D01.1.454.light.4.raw
agtatacatacacgaccggtgctcgatttagatcgtctgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 569348 - DNA, 497 bp, Homo sapiens; identical to SEQ ID NO: 536807
  misc_feature: HIJSMM301DEAH1.10.37.D04.1.454.light.4.raw

SEQ ID NO: 569349 - DNA, 501 bp, Homo sapiens
  misc_feature: HIJSMM301C316A.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 569350 - DNA, 496 bp, Homo sapiens; identical to SEQ ID NO: 535109
  misc_feature: HIJSMM301CYZ7F.16.78.H01.1.454.light.4.raw

SEQ ID NO: 569351 - DNA, 508 bp, Homo sapiens
  misc_feature: HIJSMM301AEWVV.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtccagcagtataatgactgggttttattctactttcggtccctcgggtaccgaaacgtaggagtttctagacgaacgtagtggcgtgcgaccaactctgtcttcta

SEQ ID NO: 569352 - DNA, 486 bp, Homo sapiens; identical to SEQ ID NO: 535290
  misc_feature: HIJSMM301BEK97.3.12.B01.1.454.light.4.raw

SEQ ID NO: 569353 - DNA, 486 bp, Homo sapiens; identical to SEQ ID NO: 535917
  misc_feature: HIJSMM301CALHZ.3.10.A10.1.454.light.4.raw

SEQ ID NO: 569354 - DNA, 486 bp, Homo sapiens; identical to SEQ ID NO: 535290
  misc_feature: HIJSMM301DG640.3.12.B01.1.454.light.4.raw

SEQ ID NO: 569355 - DNA, 481 bp, Homo sapiens; identical to SEQ ID NO: 535993
  misc_feature: HIJSMM301DUJI0.21.25.C03.1.454.light.4.raw

SEQ ID NO: 569356 - DNA, 498 bp, Homo sapiens; identical to SEQ ID NO: 535974
  misc_feature: HIJSMM301DX7P9.22.27.C05.1.454.light.4.raw

SEQ ID NO: 569357 - DNA, 514 bp, Homo sapiens; identical to SEQ ID NO: 541418
  misc_feature: HIJSMM301DCDGG.17.33.C11.1.454.light.4.raw

SEQ ID NO: 569358 - DNA, 484 bp, Homo sapiens; identical to SEQ ID NO: 536162
  misc_feature: HIJSMM301DJ15B.13.59.F04.1.454.light.4.raw

SEQ ID NO: 569359 - DNA, 499 bp, Homo sapiens
  misc_feature: HIJSMM301C0IW9.10.77.G11.1.454.light.4.raw
  modified_base (466)..(466): a, c, t, g, unknown or other
catagtagtgcacgaccggtgctcgatttagctagtcactcaaggggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtgcagtgggtctgggacagacttcactctcaccatcagcagactagagcctgaagattttgcagtttattactgtcagcagcgtagcaactggcctcggacgtcgtcgacggacgaacgtacggacgaganacgacgaacacgtggtccgtgcgccactctctt

SEQ ID NO: 569360 - DNA, 481 bp, Homo sapiens; identical to SEQ ID NO: 535993
  misc_feature: HIJSMM301DL2NA.21.25.C03.1.454.light.4.raw

SEQ ID NO: 569361 - DNA, 489 bp, Homo sapiens
  misc_feature: HIJSMM301CHY8C.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcaccatctgtt

SEQ ID NO: 569362 - DNA, 520 bp, Homo sapiens
  misc_feature: HIJSMM301AH7S4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacgggaccgaacggtaggaaggtacgaaacgaactagtggcgtgcaccactctcgtcttctatcttcccgtcccact

SEQ ID NO: 569363 - DNA, 504 bp, Homo sapiens; identical to SEQ ID NO: 555616
  misc_feature: HIJSMM301EYNP0.5.86.H09.1.454.light.4.raw

SEQ ID NO: 569364 - DNA, 494 bp, Homo sapiens; identical to SEQ ID NO: 535276
  misc_feature: HIJSMM301B9185.16.6.A06.1.454.light.4.raw

SEQ ID NO: 569365 - DNA, 302 bp, Homo sapiens; identical to SEQ ID NO: 564509
  misc_feature: HIJSMM301A617O.13.11.A11.1.454.light.4.raw

SEQ ID NO: 569366 - DNA, 490 bp, Homo sapiens
  misc_feature: HIJSMM301AWZ46.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagatttttactttcaccatcagcagcctgcagcctgaagatattgcaacatattactgtcaacagtatcataatctccccacctttcggtccctgggaccaaagtaggatatcaaacgaactagtggctgcaccatctgt

SEQ ID NO: 569367 - DNA, 506 bp, Homo sapiens; identical to SEQ ID NO: 545348
  misc_feature: HIJSMM301BPETN.8.33.C11.1.454.light.4.raw

SEQ ID NO: 569368 - DNA, 493 bp, Homo sapiens; identical to SEQ ID NO: 541489
  misc_feature: HIJSMM301DQD67.12.23.C01.1.454.light.4.raw

SEQ ID NO: 569369 - DNA, 494 bp, Homo sapiens
  misc_feature: HIJSMM301ESB3L.27.78.H01.1.454.light.4.raw
agcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctctgggttccagcctccaggggtgaaattgtgctcgactcagtctccagactttcagtctgtgactccaaaggagaaagtcaccatcacctgccgggccagtcagagcgttggtagtagcttaccactggtaccagcagaagccaggtcagtctccaaagctcctcatcaagtatgcttcccagtccttctcaggggtcccctcgaggttcagtggcagtggatctgggacacatttcaccctcaccatcaatagtctggaagctgaagatgctgcaacttattactgtcatcagagtactactttacctcaagtgatcaccttcggccaagggacacgact

SEQ ID NO: 569370 - DNA, 486 bp, Homo sapiens
  misc_feature: HIJSMM301ERWA2.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaacg

SEQ ID NO: 569371 - DNA, 480 bp, Homo sapiens
  misc_feature: HIJSMM301AUDWR.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaaggtaggagatcgaacgaactagtggctgca

SEQ ID NO: 569372 - DNA, 505 bp, Homo sapiens
  misc_feature: HIJSMM301BMJFO.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggcccaacccactgtcta

SEQ ID NO: 569373 - DNA, 491 bp, Homo sapiens
  misc_feature: HIJSMM301A1O50.43.78.H01.1.454.light.4.raw
tgtgagtagtcacgaccggtgctcgatttagtgtgagtagtttgggtttggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgt

SEQ ID NO: 569374 - DNA, 489 bp, Homo sapiens; identical to SEQ ID NO: 544329
  misc_feature: HIJSMM301AGQMJ.11.28.C06.1.454.light.4.raw

SEQ ID NO: 569375 - DNA, 522 bp, Homo sapiens
  misc_feature: HIJSMM301DE80P.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcctcc

SEQ ID NO: 569376 - DNA, 493 bp, Homo sapiens; identical to SEQ ID NO: 544666
  misc_feature: HIJSMM301D2E9F.12.23.C01.1.454.light.4.raw

SEQ ID NO: 569377 - DNA, 518 bp, Homo sapiens
  misc_feature: HIJSMM301BFRKC.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtaggaaagtacgtaagacgaaccgtagtggctgcgaccactctgtcttctactcttcccgt

SEQ ID NO: 569378 - DNA, 349 bp, Homo sapiens; identical to SEQ ID NO: 537129
  misc_feature: HIJSMM301DLN7H.13.11.A11.1.454.light.4.raw

SEQ ID NO: 569379 - DNA, 502 bp, Homo sapiens
  misc_feature: HIJSMM301CK122.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaaatcaaacgaactgtggctgcaccatctgtcttctatcttccccg

SEQ ID NO: 569380 - DNA, 486 bp, Homo sapiens
  misc_feature: HIJSMM301D28RQ.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagttttcactacccctctcactttcggcgggggaccgaaaggtggagatcaaacgaaactgtggctgcacca

SEQ ID NO: 569381 - DNA, 486 bp, Homo sapiens
  misc_feature: HIJSMM301BHGH3.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgctagtttatttctgtcagcagtttaacacctggcctggaagttttggccaggggaccaagctggagctcaaacgaactgtggctgcaccat

SEQ ID NO: 569382 - DNA, 519 bp, Homo sapiens
  misc_feature: HIJSMM301D9IUN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtccgccct

SEQ ID NO: 569383 - DNA, 498 bp, Homo sapiens; identical to SEQ ID NO: 544690
  misc_feature: HIJSMM301BEI6C.41.6.A06.1.454.light.4.raw

SEQ ID NO: 569384 - DNA, 501 bp, Homo sapiens
  misc_feature: HIJSMM301BZBQN.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggtgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaagtacaaacgaactagtggctgcaccatctgtcttcattcc

SEQ ID NO: 569385 - DNA, 494 bp, Homo sapiens; identical to SEQ ID NO: 541400
  misc_feature: HIJSMM301CU37V.51.71.G05.1.454.light.4.raw

SEQ ID NO: 569386 - DNA, 462 bp, Homo sapiens
  misc_feature: HIJSMM301A6070.49.2.A02.1.454.light.4.raw
agtcgagagacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 569387 - DNA, 496 bp, Homo sapiens; identical to SEQ ID NO: 537925
  misc_feature: HIJSMM301BC38G.22.14.B03.1.454.light.4.raw

SEQ ID NO: 569388 - DNA, 494 bp, Homo sapiens
  misc_feature: HIJSMM301D7H6J.27.78.H01.1.454.light.4.raw
  modified_base (426)..(426): a, c, t, g, unknown or other
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactgganattaaacgaactgtggctgcaccatctgtctt

SEQ ID NO: 569389 - DNA, 483 bp, Homo sapiens
  misc_feature: HIJSMM301CJ66D.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttgccagggaccaagctggagatcaaacgaactgtggctgcaccat

SEQ ID NO: 569390 - DNA, 489 bp, Homo sapiens; identical to SEQ ID NO: 549568
  misc_feature: HIJSMM301AUFUC.43.33.C11.1.454.light.4.raw

SEQ ID NO: 569391 - DNA, 447 bp, Homo sapiens; identical to SEQ ID NO: 535020
  misc_feature: HIJSMM301ERQOU.18.9.A09.1.454.light.4.raw

SEQ ID NO: 569392 - DNA, 498 bp, Homo sapiens; identical to SEQ ID NO: 535295
  misc_feature: HIJSMM301AGBEK.15.25.C03.1.454.light.4.raw

SEQ ID NO: 569393 - DNA, 501 bp, Homo sapiens
  misc_feature: HIJSMM301BFUJR.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 569394 - DNA, 485 bp, Homo sapiens; identical to SEQ ID NO: 535363
  misc_feature: HIJSMM301EUIKT.17.26.C04.1.454.light.4.raw

SEQ ID NO: 569395 - DNA, 489 bp, Homo sapiens
  misc_feature: HIJSMM301B9R15.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtggatctggcacagatttcactctcaccatcagcagcctgcagcctgaagatttcgcaacttattactgtctacaagattacaattaccctcggacgttcggccaggggaccgaaggcggaaatacaaacgaactagtggctgcacca

SEQ ID NO: 569396 - DNA, 485 bp, Homo sapiens
  misc_feature: HIJSMM301B7RQT.49.60.F05.1.454.light.4.raw
agtcgagagacacgaccggtgctcgatttagtacgtcatcaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaa

SEQ ID NO: 569397 - DNA, 502 bp, Homo sapiens
  misc_feature: HIJSMM301DVE6S.12.86.H09.1.454.light.4.raw
atacgacgtacacgaccggtgctcgatttagtgctatagacttgggtttgggggagggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgccatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 569398 - DNA, 493 bp, Homo sapiens
  misc_feature: HIJSMM301DXJEM.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaactgtggctgca

SEQ ID NO: 569399 - DNA, 488 bp, Homo sapiens
  misc_feature: HIJSMM301A6S9S.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggccaaggcggagatcagacgaactgtggctgcaccatctgtcttcta

SEQ ID NO: 569400 - DNA, 502 bp, Homo sapiens
  misc_feature: HIJSMM301DLP50.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtctaagtcagccaaggctgccccctcggtcactctgttcccacct

SEQ ID NO: 569401 - DNA, 491 bp, Homo sapiens
  misc_feature: HIJSMM301BVU1P.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatcaccttcggccaagggacacgactggagattaaacgaactgtggctgcaccatctgtcttcat

SEQ ID NO: 569402 - DNA, 515 bp, Homo sapiens
  misc_feature: HIJSMM301BLSUI.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctggtcactctgttcccaccctcctccg

SEQ ID NO: 569403 - DNA, 512 bp, Homo sapiens
  misc_feature: HIJSMM301AGFSB.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggccaagttgaccgtcctaggtcagcccaaggctgccccctcggtcactctgttcccc

SEQ ID NO: 569404 - DNA, 482 bp, Homo sapiens
  misc_feature: HIJSMM301DV2R8.40.63.F08.1.454.light.4.raw
  modified_base (406)..(406): a, c, t, g, unknown or other
tctagcgactcacgaccggtgctcgatttagcgatcgtataagggggcaggagtcagtctcagtcaggacacagcatggacatgagggtccccgctcagctcctggggctcctgctactctggctccgaggtgccacatgtgacatccagatgacccagtctccatcctccctgtctgcatccgtagggacagagtcaccatcgcttgccgggcaagtcagcccatgaccaatcatttaagttggtatcagcagaaaccagggaaagcccctagactcctgatctatactgcgtccactttgcaaggtgggtcccccaaggttcagtggcagtggatctggaacagaattcactctcaccatcagcggcctgcagtctgatgattttgcaacttatttctgccaanagtatcatacttattctcggaccttcggccgaaggaccagggtggaaatcaaacgaactgtggctgcaccatctgt

SEQ ID NO: 569405 - DNA, 483 bp, Homo sapiens
  misc_feature: HIJSMM301APG3W.52.53.E09.1.454.light.4.raw
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcgggagggaccaagttgaccgtctaggtcagcccaaggctcg

SEQ ID NO: 569406 - DNA, 518 bp, Homo sapiens
  misc_feature: HIJSMM301AOF9Q.48.14.B03.1.454.light.4.raw
agtatacatacacgaccggtgctcgatttagtgtgagtagttccgcgggcggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgtcggccgaagggacccgggtaggaaataaaacgaa

SEQ ID NO: 569407 - DNA, 493 bp, Homo sapiens; identical to SEQ ID NO: 537422
  misc_feature: HIJSMM301CN76O.9.34.D01.1.454.light.4.raw

SEQ ID NO: 569408 - DNA, 405 bp, Homo sapiens
  misc_feature: HIJSMM301CM71N.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttccccgccctcctcctacagtgct

SEQ ID NO: 569409 - DNA, 507 bp, Homo sapiens; identical to SEQ ID NO: 538702
  misc_feature: HIJSMM301DJWAV.11.57.F02.1.454.light.4.raw

SEQ ID NO: 569410 - DNA, 490 bp, Homo sapiens; identical to SEQ ID NO: 538273
  misc_feature: HIJSMM301AUBJP.16.73.G07.1.454.light.4.raw

SEQ ID NO: 569411 - DNA, 476 bp, Homo sapiens; identical to SEQ ID NO: 547834
  misc_feature: HIJSMM301DJ0O0.5.15.B04.1.454.light.4.raw

SEQ ID NO: 569412 - DNA, 487 bp, Homo sapiens; identical to SEQ ID NO: 536206
  misc_feature: HIJSMM301AV9UD.47.38.D05.1.454.light.4.raw

SEQ ID NO: 569413 - DNA, 503 bp, Homo sapiens; identical to SEQ ID NO: 561368
  misc_feature: HIJSMM301BX7D5.48.36.D03.1.454.light.4.raw

SEQ ID NO: 569414 - DNA, 497 bp, Homo sapiens
  misc_feature: HIJSMM301AKVLE.16.78.H01.1.454.light.4.raw
tgtactactccacgaccggtgctcgatttagtgtgagtagtttgggtttggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 569415 - DNA, 496 bp, Homo sapiens
  misc_feature: HIJSMM301EK8NV.10.65.F10.1.454.light.4.raw
  modified_base (457)..(457): a, c, t, g, unknown or other
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaacccgttactttcggcggagggaccaaggtggagatnaaacgaactgtggctgcaccatctgtcttcgtcttcccg

SEQ ID NO: 569416 - DNA, 507 bp, Homo sapiens
  misc_feature: HIJSMM301DLU16.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttggccaagggaccaaggtggaagtcaagcgaactgtggctgcaccatctgtcttcatcttcccgcc

SEQ ID NO: 569417 - DNA, 511 bp, Homo sapiens; identical to SEQ ID NO: 557789
  misc_feature: HIJSMM301CJSYA.53.71.G05.1.454.light.4.raw

SEQ ID NO: 569418 - DNA, 487 bp, Homo sapiens; identical to SEQ ID NO: 537220
  misc_feature: HIJSMM301DBACL.16.53.E09.1.454.light.4.raw

SEQ ID NO: 569419 - DNA, 488 bp, Homo sapiens; identical to SEQ ID NO: 542699
  misc_feature: HIJSMM301C4DEF.12.51.E07.1.454.light.4.raw

SEQ ID NO: 569420 - DNA, 492 bp, Homo sapiens
  misc_feature: HIJSMM301BTHYK.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctggttcggcggcgggaccaagttgaccgtcctacg

SEQ ID NO: 569421 - DNA, 441 bp, Homo sapiens; identical to SEQ ID NO: 534971
  misc_feature: HIJSMM301AIHKD.11.3.A03.1.454.light.4.raw

SEQ ID NO: 569422 - DNA, 510 bp, Homo sapiens
  misc_feature: HIJSMM301CRSZ9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtctagcagtatggtcgacgtcccaacgaactttaggttccgacggggaccgaacgacgtggaggagtacaaacgaaactacgtggcgtgcaccactcttcg

SEQ ID NO: 569423 - DNA, 501 bp, Homo sapiens
  misc_feature: HIJSMM301CH5PC.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctctactttcggcggagggaccaaggtggagctcaaacgaactgtggctgcaccatctgtcttcattccc

SEQ ID NO: 569424 - DNA, 441 bp, Homo sapiens; identical to SEQ ID NO: 550529
  misc_feature: HIJSMM301B6JU1.41.9.A09.1.454.light.4.raw

SEQ ID NO: 569425 - DNA, 460 bp, Homo sapiens; identical to SEQ ID NO: 537107
  misc_feature: HIJSMM301CXHYW.22.28.C06.1.454.light.4.raw

SEQ ID NO: 569426 - DNA, 502 bp, Homo sapiens; identical to SEQ ID NO: 536253
  misc_feature: HIJSMM301CVXUD.21.22.B11.1.454.light.4.raw

SEQ ID NO: 569427 - DNA, 496 bp, Homo sapiens; identical to SEQ ID NO: 535109
  misc_feature: HIJSMM301EX2H9.16.78.H01.1.454.light.4.raw

SEQ ID NO: 569428 - DNA, 502 bp, Homo sapiens; identical to SEQ ID NO: 536253
  misc_feature: HIJSMM301BZTXB.21.22.B11.1.454.light.4.raw

SEQ ID NO: 569429 - DNA, 482 bp, Homo sapiens; identical to SEQ ID NO: 538815
  misc_feature: HIJSMM301AIVES.4.34.D01.1.454.light.4.raw

SEQ ID NO: 569430 - DNA, 494 bp, Homo sapiens
  misc_feature: HIJSMM301CGQNS.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatatcctcctcagacgttcggccaagggaccaaggtggaatcaaacgaactgtggctgcacca

SEQ ID NO: 569431 - DNA, 484 bp, Homo sapiens; identical to SEQ ID NO: 544700
  misc_feature: HIJSMM301AUPZP.41.78.H01.1.454.light.4.raw

SEQ ID NO: 569432 - DNA, 492 bp, Homo sapiens; identical to SEQ ID NO: 537395
  misc_feature: HIJSMM301BDBQL.16.73.G07.1.454.light.4.raw

SEQ ID NO: 569433 - DNA, 517 bp, Homo sapiens
  misc_feature: HIJSMM301DDT1U.52.57.F02.1.454.light.4.raw
cgcagtacgacacgaccggtgctcgatttagctcgatatagttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacggtcagcccaaggctgccccctggtcactctgtt

SEQ ID NO: 569434 - DNA, 489 bp, Homo sapiens
  misc_feature: HIJSMM301EXSN4.47.70.G04.1.454.light.4.raw
  modified_base (410)..(410): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaanacccgagttacggtacccgtacactttggtccagggaccaaactggacatcaaacgaactagtggctgcaccatctgtt

SEQ ID NO: 569435 - DNA, 496 bp, Homo sapiens
  misc_feature: HIJSMM301C7MY4.48.28.C06.1.454.light.4.raw
  modified_base (457)..(457): a, c, t, g, unknown or other
agtatacatacacgaccggtgctcgatttagagctcacgtattgggtttggggagcttcagctgtgggtagagaagacaggactcaggacaatctccagcatggccagcttccctctcctcctcaccctcctcactcactgtgcagggtcctgggcccagtctgtgctgactcagtcaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtggatgacagcctgaatgcttggggtnttcggcggagggaccaagttgacgtcctaggtcaaccaa

SEQ ID NO: 569436 - DNA, 520 bp, Homo sapiens; identical to SEQ ID NO: 539176
  misc_feature: HIJSMM301C2E4U.27.23.C01.1.454.light.4.raw

SEQ ID NO: 569437 - DNA, 488 bp, Homo sapiens; identical to SEQ ID NO: 538811
  misc_feature: HIJSMM301BP3SV.40.83.H06.1.454.light.4.raw

SEQ ID NO: 569438 - DNA, 498 bp, Homo sapiens
  misc_feature: HIJSMM301D88FH.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtaggaagtcaaacgaactagtggctgcgaccatctgtcttcatcttcccgt

SEQ ID NO: 569439 - DNA, 486 bp, Homo sapiens; identical to SEQ ID NO: 535043
  misc_feature: HIJSMM301A2G7V.46.35.D02.1.454.light.4.raw

SEQ ID NO: 569440 - DNA, 478 bp, Homo sapiens
  misc_feature: HIJSMM301DDO87.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatacaaacgaactgtggctgcaccat

SEQ ID NO: 569441 - DNA, 491 bp, Homo sapiens
  misc_feature: HIJSMM301BYS6J.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaacgaactgtggctgcaccatcttcg

SEQ ID NO: 569442 - DNA, 515 bp, Homo sapiens
  misc_feature: HIJSMM301AWJ20.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtacggaagtacaagacgaactacgtggcgtgcaccaactctgtcttctactcttcccgt

SEQ ID NO: 569443 - DNA, 496 bp, Homo sapiens; identical to SEQ ID NO: 535109
  misc_feature: HIJSMM301BF5JA.16.78.H01.1.454.light.4.raw

SEQ ID NO: 569444 - DNA, 496 bp, Homo sapiens; identical to SEQ ID NO: 536248
  misc_feature: HIJSMM301EA27P.22.27.C05.1.454.light.4.raw

SEQ ID NO: 569445 - DNA, 495 bp, Homo sapiens; identical to SEQ ID NO: 542416
  misc_feature: HIJSMM301ASUTX.27.78.H01.1.454.light.4.raw

SEQ ID NO: 569446 - DNA, 510 bp, Homo sapiens
  misc_feature: HIJSMM301DALL1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccgaaggtggaaagtacaaaacgaactagtggctgcaccatctgtcttctatcttccccg

SEQ ID NO: 569447 - DNA, 445 bp, Homo sapiens; identical to SEQ ID NO: 551846
  misc_feature: HIJSMM301CSR1G.14.76.G10.1.454.light.4.raw

SEQ ID NO: 569448 - DNA, 516 bp, Homo sapiens
  misc_feature: HIJSMM301CU812.48.61.F06.1.454.light.4.raw
agtatacatacacgaccggtgctcgatttagctacgctctaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccct

SEQ ID NO: 569449 - DNA, 509 bp, Homo sapiens; identical to SEQ ID NO: 540142
  misc_feature: HIJSMM301DN9NB.8.38.D05.1.454.light.4.raw

SEQ ID NO: 569450 - DNA, 504 bp, Homo sapiens; identical to SEQ ID NO: 549905
  misc_feature: HIJSMM301DD3D8.48.71.G05.1.454.light.4.raw

SEQ ID NO: 569451 - DNA, 500 bp, Homo sapiens; identical to SEQ ID NO: 535270
  misc_feature: HIJSMM301D20FA.19.78.H01.1.454.light.4.raw

SEQ ID NO: 569452 - DNA, 503 bp, Homo sapiens
  misc_feature: HIJSMM301BFWO1.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctccggtcactcc

SEQ ID NO: 569453 - DNA, 509 bp, Homo sapiens
  misc_feature: HIJSMM301DG71B.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactacactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccta

SEQ ID NO: 569454 - DNA, 496 bp, Homo sapiens; identical to SEQ ID NO: 551255
  misc_feature: HIJSMM301B1W8L.10.33.C11.1.454.light.4.raw

SEQ ID NO: 569455 - DNA, 484 bp, Homo sapiens
  misc_feature: HIJSMM301BKHOJ.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacc

SEQ ID NO: 569456 - DNA, 483 bp, Homo sapiens
  misc_feature: HIJSMM301CMGAC.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggaggaccgacggtggagatcaacgaactagtggctgcaccatctgt

SEQ ID NO: 569457 - DNA, 488 bp, Homo sapiens; identical to SEQ ID NO: 535081
  misc_feature: HIJSMM301CNZC1.26.23.C01.1.454.light.4.raw

SEQ ID NO: 569458 - DNA, 516 bp, Homo sapiens
  misc_feature: HIJSMM301AVIJS.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccctgactatcagtggggcccgaaagtggaggatgaagctgactactactgttactcaatagagaacaagtgataaatttctgggtggttcggcggagggaccaaactagaccgtcctaaggtcagcccaaggctgccccctcggtcactctgttccccg

SEQ ID NO: 569459 - DNA, 505 bp, Homo sapiens; identical to SEQ ID NO: 535503
  misc_feature: HIJSMM301C65OK.8.28.C06.1.454.light.4.raw

SEQ ID NO: 569460 - DNA, 474 bp, Homo sapiens
  misc_feature: HIJSMM301C3IGP.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctccccaatttcggccctgggaccagagtggacatgaaacgaactgtggctgca

SEQ ID NO: 569461 - DNA, 492 bp, Homo sapiens; identical to SEQ ID NO: 536087
  misc_feature: HIJSMM301EBCKE.10.17.B06.1.454.light.4.raw

SEQ ID NO: 569462 - DNA, 478 bp, Homo sapiens
  misc_feature: HIJSMM301AOKFQ.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcgcgggggaccaaggtggagatcaaacgaactagtggctgcacc

SEQ ID NO: 569463 - DNA, 500 bp, Homo sapiens; identical to SEQ ID NO: 546613
  misc_feature: HIJSMM301AY2OM.11.21.B10.1.454.light.4.raw

SEQ ID NO: 569464 - DNA, 508 bp, Homo sapiens
  misc_feature: HIJSMM301BL8QT.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgaccaaccggccctcaaacatttcagagagattttctacctccaggacacaaatacagcctctctgaccattactggtctccagcctgacgacgaggctgactactactgctcagcctgggacaccagcctcgctgcttggcttttcggcggagggaccaagctgaccgtcctgggtcagcccaaggcctcgccccctcggtccta

SEQ ID NO: 569465 - DNA, 510 bp, Homo sapiens
  misc_feature: HIJSMM301BI9V3.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgtccaccctcctcctagtctacg

SEQ ID NO: 569466 - DNA, 510 bp, Homo sapiens
  misc_feature: HIJSMM301BTTUH.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtgacagtagatctggaacagattttaccctcaccatcaggggtctacagcctgaagattttgcgacttactattgtcaacagagttaccttctcccccggacgttcggtccaacggaccgaacggtggaagtacaagcgaactagtggctgcaccaatctgtcttctactcttcccgt

SEQ ID NO: 569467 - DNA, 484 bp, Homo sapiens; identical to SEQ ID NO: 535240
  misc_feature: HIJSMM301B4FSQ.47.60.F05.1.454.light.4.raw

SEQ ID NO: 569468 - DNA, 498 bp, Homo sapiens
  misc_feature: HIJSMM301DWBLG.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggtccaggggaccaagctggagatcaaacgaactgtggctgcaccatctgtt

SEQ ID NO: 569469 - DNA, 488 bp, Homo sapiens
  misc_feature: HIJSMM301DU48X.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtaggagatacaaacgaa

SEQ ID NO: 569470 - DNA, 490 bp, Homo sapiens; identical to SEQ ID NO: 541407
  misc_feature: HIJSMM301APMMG.14.55.E11.1.454.light.4.raw

SEQ ID NO: 569471 - DNA, 482 bp, Homo sapiens
  misc_feature: HIJSMM301DLHWW.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcacccaatttggaatcaggggtcccatcaaggttcagtggaagtggatctgggacagattttactttcaccatcaccagcctgcagcctgaagatattgcaacatattactgtcaacagtatgataatctccctcccactttcggcgagggaccaaggtggagatcaaacgaactgtggctgcaccat

SEQ ID NO: 569472 - DNA, 491 bp, Homo sapiens
  misc_feature: HIJSMM301BSZM9.14.55.E11.1.454.light.4.raw
  modified_base (428)..(428): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcacccagtttgcacagtggggtcccgtcaaggttcagtggcagtggatctgggacagatttcactctcaccgtcagcagtctgcaacctgaagattttgcaacttactactgtcaacagagttacacgtacccccctnactttcggcggagggaccaaggcggagatcagacgaactgtggctgcaccatctgtcttcatt

SEQ ID NO: 569473 - DNA, 519 bp, Homo sapiens
  misc_feature: HIJSMM301CS803.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttggcggagggaccaggctgaccgtcctaggtcagcccaaggctgccccctcggtcactctgttcccgcct

SEQ ID NO: 569474 - DNA, 487 bp, Homo sapiens; identical to SEQ ID NO: 550363
  misc_feature: HIJSMM301AJ5GD.19.71.G05.1.454.light.4.raw

SEQ ID NO: 569475 - DNA, 478 bp, Homo sapiens
  misc_feature: HIJSMM301D0BCN.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcgggcggagggaccaaactgaccgtctaggtcagcccaaggctg

SEQ ID NO: 569476 - DNA, 506 bp, Homo sapiens; identical to SEQ ID NO: 535404
  misc_feature: HIJSMM301C1WIK.10.88.H11.1.454.light.4.raw

SEQ ID NO: 569477 - DNA, 484 bp, Homo sapiens
  misc_feature: HIJSMM301C1R0J.49.53.E09.1.454.light.4.raw
agtcgagagacacgaccggtgctcgatttagagagagtgtgttgggtttgggtgctcgatttagatcgtctgtgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacagggtcccatcaaggttcagtggaagtggatctgggacagattttactttcaccatcagcagcctgcagcctgaagatattgcaacatattactgtcaacagtatgataatctcccactcactttcggcggagggaccaa

SEQ ID NO: 569478 - DNA, 500 bp, Homo sapiens; identical to SEQ ID NO: 542309
  misc_feature: HIJSMM301C8Y3O.12.86.H09.1.454.light.4.raw

SEQ ID NO: 569479 - DNA, 445 bp, Homo sapiens
  misc_feature: HIJSMM301DGM6O.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttccccaccctcctcgacacgcgag

SEQ ID NO: 569480 - DNA, 493 bp, Homo sapiens
  misc_feature: HIJSMM301DIITX.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcaccgtcagcagactggaccctgaagattttgcagtgtattactgtcagcagtatggtagctcaccgatcaccttcggccaagggacacgactggagattaacgaacctgtggctgcaccatctgtctt

SEQ ID NO: 569481 - DNA, 484 bp, Homo sapiens
  misc_feature: HIJSMM301B5MAI.48.79.H02.1.454.light.4.raw
agtatacatacacgaccggtgctcgatttagtgtcacacgaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaa

SEQ ID NO: 569482 - DNA, 517 bp, Homo sapiens; identical to SEQ ID NO: 541775
  misc_feature: HIJSMM301CTNVJ.5.27.C05.1.454.light.4.raw

SEQ ID NO: 569483 - DNA, 490 bp, Homo sapiens; identical to SEQ ID NO: 549445
  misc_feature: HIJSMM301B52TF.52.85.H08.1.454.light.4.raw

SEQ ID NO: 569484 - DNA, 503 bp, Homo sapiens; identical to SEQ ID NO: 546983
  misc_feature: HIJSMM301BZVOF.21.22.B11.1.454.light.4.raw

SEQ ID NO: 569485 - DNA, 501 bp, Homo sapiens; identical to SEQ ID NO: 536867
  misc_feature: HIJSMM301B7ZUI.5.86.H09.1.454.light.4.raw

SEQ ID NO: 569486 - DNA, 494 bp, Homo sapiens
  misc_feature: HIJSMM301DCG5A.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcatttccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctgtt

SEQ ID NO: 569487 - DNA, 490 bp, Homo sapiens
  misc_feature: HIJSMM301B94QW.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatacattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccactgt

SEQ ID NO: 569488 - DNA, 521 bp, Homo sapiens
  misc_feature: HIJSMM301A5MVO.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttataaccttgtctcctggtaccaacagcaaccaggcaaacgccccctaaacttttggtttatcgagggcaataagcggccctcgaggggtttctaatcgcttctctggctccaagtctggcaacacggccgccctgacaatctctgggctccaggctgacgacgaggctgtatttttactgctgctcatatgcaggtgatcactacttttatgttcgggactgggaccaaggtcaccgtcctaggtcagcccaaggcccaaccccactgtcactcttccg

SEQ ID NO: 569489 - DNA, 506 bp, Homo sapiens; identical to SEQ ID NO: 566446
  misc_feature: HIJSMM301BPLUT.10.29.C07.1.454.light.4.raw

SEQ ID NO: 569490 - DNA, 442 bp, Homo sapiens
  misc_feature: HIJSMM301DBFNG.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctcgttcccaccctcctcgtatctctcg

SEQ ID NO: 569491 - DNA, 454 bp, Homo sapiens; identical to SEQ ID NO: 534964
  misc_feature: HIJSMM301CLP65.19.86.H09.1.454.light.4.raw

SEQ ID NO: 569492 - DNA, 465 bp, Homo sapiens
  misc_feature: HIJSMM301A5XG0.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttccccgccctcctccatactcgta

SEQ ID NO: 569493 - DNA, 460 bp, Homo sapiens
  misc_feature: HIJSMM301CER09.49.11.A11.1.454.light.4.raw
agtcgagagacacgaccggtgctcgatttagctacgactgcaggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacagggtcccatcaaggttcagtggaagtggctctgggacagattttactttcaccatcagcagactgcagcctgaagatattgcaacatattactgtcaacagtatgatagtctcccgctcactttcggcggagggaccaaggtggagatacaacgaa

SEQ ID NO: 569494 - DNA, 505 bp, Homo sapiens
  misc_feature: HIJSMM301CMDJ4.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactagaaaatcagtagaggtggaggctggaggatggttgggtagtttattacgtgactagtgacaagtctactaacaaaccttcctctctactttcggcgggacggaccgaaggtggagatacaaacgaact

SEQ ID NO: 569495 - DNA, 496 bp, Homo sapiens
  misc_feature: HIJSMM301B4TH5.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcattcc

SEQ ID NO: 569496 - DNA, 497 bp, Homo sapiens; identical to SEQ ID NO: 539058
  misc_feature: HIJSMM301AJCG7.12.87.H10.1.454.light.4.raw

SEQ ID NO: 569497 - DNA, 492 bp, Homo sapiens; identical to SEQ ID NO: 536010
  misc_feature: HIJSMM301A4128.10.20.B09.1.454.light.4.raw

SEQ ID NO: 569498 - DNA, 510 bp, Homo sapiens
  misc_feature: HIJSMM301C40SQ.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtccg

SEQ ID NO: 569499 - DNA, 513 bp, Homo sapiens
  misc_feature: HIJSMM301DQQNZ.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaagtacaagacgaactcgtggcgtgcgaccactctgtcgttctactt

SEQ ID NO: 569500 - DNA, 516 bp, Homo sapiens
  misc_feature: HIJSMM301APH4G.48.27.C05.1.454.light.4.raw
agtatacatacacgaccggtgctcgatttagacgcgatcgaagggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactc

SEQ ID NO: 569501 - DNA, 513 bp, Homo sapiens
  misc_feature: HIJSMM301DO9HC.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttccca

SEQ ID NO: 569502 - DNA, 486 bp, Homo sapiens; identical to SEQ ID NO: 535290
  misc_feature: HIJSMM301BVT0M.3.12.B01.1.454.light.4.raw

SEQ ID NO: 569503 - DNA, 486 bp, Homo sapiens
  misc_feature: HIJSMM301DNXOV.48.27.C05.1.454.light.4.raw
agtatacatacacgaccggtgctcgatttagacgcgatcgaagggtttgggggctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccat

SEQ ID NO: 569504 - DNA, 513 bp, Homo sapiens; identical to SEQ ID NO: 543780
  misc_feature: HIJSMM301DT9Y4.17.33.C11.1.454.light.4.raw

SEQ ID NO: 569505 - DNA, 496 bp, Homo sapiens; identical to SEQ ID NO: 536248
  misc_feature: HIJSMM301ADSUD.22.27.C05.1.454.light.4.raw

SEQ ID NO: 569506 - DNA, 505 bp, Homo sapiens
  misc_feature: HIJSMM301B9OCV.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctggccgtctctgggctccaggctgaggatgaggctgattattactgcagctcatatgcaggcagcagcagtccccatgtgatcttcggcgggggaccgaagactcgacgtcctacggtcacgccaacggcg

SEQ ID NO: 569507 - DNA, 484 bp, Homo sapiens; identical to SEQ ID NO: 550098
  misc_feature: HIJSMM301B9QSX.26.78.H01.1.454.light.4.raw

SEQ ID NO: 569508 - DNA, 494 bp, Homo sapiens; identical to SEQ ID NO: 534992
  misc_feature: HIJSMM301BSUWS.9.1.A01.1.454.light.4.raw

SEQ ID NO: 569509 - DNA, 444 bp, Homo sapiens; identical to SEQ ID NO: 538511
  misc_feature: HIJSMM301CYVLE.5.9.A09.1.454.light.4.raw
  modified_base (426)..(426): a, c, t, g, unknown or other

SEQ ID NO: 569510 - DNA, 514 bp, Homo sapiens
  misc_feature: HIJSMM301C5IFG.51.30.C08.1.454.light.4.raw
cgatcgtatacacgaccggtgctcgatttagtctgacgtcaaagggaaagggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccaagctgaccgtcctaggtcagcccaaggctgccccctcggtcactctgttcccacct

SEQ ID NO: 569511 - DNA, 495 bp, Homo sapiens; identical to SEQ ID NO: 537415
  misc_feature: HIJSMM301B1I04.4.27.C05.1.454.light.4.raw

SEQ ID NO: 569512 - DNA, 480 bp, Homo sapiens; identical to SEQ ID NO: 558689
  misc_feature: HIJSMM301BAEHZ.5.12.B01.1.454.light.4.raw

SEQ ID NO: 569513 - DNA, 491 bp, Homo sapiens
  misc_feature: HIJSMM301B4609.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaagggcggagatcagacgaactgtggctgcaccatctgtcttcta

SEQ ID NO: 569514 - DNA, 494 bp, Homo sapiens
  misc_feature: HIJSMM301D5C4F.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaaggtggagatcaaacgaactgtggctgcaccatctgtcttcatccttcccgccca

SEQ ID NO: 569515 - DNA, 506 bp, Homo sapiens
  misc_feature: HIJSMM301C5AD1.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccgaaggtggaaatacaaacgaactagtggctgcaccatctgtcttctatcttccccg

SEQ ID NO: 569516 - DNA, 501 bp, Homo sapiens; identical to SEQ ID NO: 535873
  misc_feature: HIJSMM301D3ME6.17.27.C05.1.454.light.4.raw

SEQ ID NO: 569517 - DNA, 404 bp, Homo sapiens; identical to SEQ ID NO: 535530
  misc_feature: HIJSMM301CE7FI.4.35.D02.1.454.light.4.raw

SEQ ID NO: 569518 - DNA, 512 bp, Homo sapiens
  misc_feature: HIJSMM301DFQIC.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgcccctcggtcactctgttcccaccctcctctctc

SEQ ID NO: 569519 - DNA, 484 bp, Homo sapiens; identical to SEQ ID NO: 537427
  misc_feature: HIJSMM301DV181.26.78.H01.1.454.light.4.raw

SEQ ID NO: 569520 - DNA, 504 bp, Homo sapiens
  misc_feature: HIJSMM301CCNL3.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtattggtggagggaccaagctgaccgtcctaggtcagcccaaggctgccccctggt

SEQ ID NO: 569521 - DNA, 512 bp, Homo sapiens
  misc_feature: HIJSMM301DFV19.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaacggtggaagtcaagcgaactgtggctgcaccatctgtcttcatcttcccgccact

SEQ ID NO: 569522 - DNA, 490 bp, Homo sapiens; identical to SEQ ID NO: 542534
  misc_feature: HIJSMM301BP6T5.16.68.G02.1.454.light.4.raw

SEQ ID NO: 569523 - DNA, 517 bp, Homo sapiens; identical to SEQ ID NO: 538938
  misc_feature: HIJSMM301B5LVE.7.86.H09.1.454.light.4.raw

SEQ ID NO: 569524 - DNA, 487 bp, Homo sapiens
  misc_feature: HIJSMM301AEX7P.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttactttgtcaacagactaactcattccctcgcagttttggtccaggggaccaaggtggagatcaacgaactgtggctgcaccatctgtcttcatt

SEQ ID NO: 569525 - DNA, 492 bp, Homo sapiens; identical to SEQ ID NO: 547275
  misc_feature: HIJSMM301ADWC7.43.53.E09.1.454.light.4.raw

SEQ ID NO: 569526 - DNA, 476 bp, Homo sapiens; identical to SEQ ID NO: 543112
  misc_feature: HIJSMM301B9ROH.17.29.C07.1.454.light.4.raw

SEQ ID NO: 569527 - DNA, 494 bp, Homo sapiens
  misc_feature: HIJSMM301DHESK.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaatccctcacgttcggcggagggaccaaggtggagatcaaacgaactgtggctgcaccatctgtcttcatcttcccgcc

SEQ ID NO: 569528 - DNA, 486 bp, Homo sapiens
  misc_feature: HIJSMM301B84M2.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggaggggaccaagggtggagatcaaacgaa

SEQ ID NO: 569529 - DNA, 453 bp, Homo sapiens
  misc_feature: HIJSMM301ERK4R.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctccccacgagagta

SEQ ID NO: 569530 - DNA, 495 bp, Homo sapiens; identical to SEQ ID NO: 535596
  misc_feature: HIJSMM301CHDQJ.10.79.H02.1.454.light.4.raw

SEQ ID NO: 569531 - DNA, 488 bp, Homo sapiens; identical to SEQ ID NO: 541987
  misc_feature: HIJSMM301ECIFL.8.12.B01.1.454.light.4.raw

SEQ ID NO: 569532 - DNA, 497 bp, Homo sapiens; identical to SEQ ID NO: 534982
  misc_feature: HIJSMM301DNFAK.26.80.H03.1.454.light.4.raw

SEQ ID NO: 569533 - DNA, 482 bp, Homo sapiens
  misc_feature: HIJSMM301EXPJI.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttatactgtcatcaatatggtgaccggcccacgttcggccaagggaccaaggtggaaatcaaacgaactgtggctgcaccatctgtctt

SEQ ID NO: 569534 - DNA, 485 bp, Homo sapiens; identical to SEQ ID NO: 542576
  misc_feature: HIJSMM301D787Z.15.1.A01.1.454.light.4.raw

SEQ ID NO: 569535 - DNA, 503 bp, Homo sapiens; identical to SEQ ID NO: 535044
  misc_feature: HIJSMM301ASJ8T.19.78.H01.1.454.light.4.raw

SEQ ID NO: 569536 - DNA, 495 bp, Homo sapiens; identical to SEQ ID NO: 538434
  misc_feature: HIJSMM301C62G8.51.81.H04.1.454.light.4.raw

SEQ ID NO: 569537 - DNA, 503 bp, Homo sapiens; identical to SEQ ID NO: 543938
  misc_feature: HIJSMM301B0VUW.4.71.G05.1.454.light.4.raw

SEQ ID NO: 569538 - DNA, 484 bp, Homo sapiens
  misc_feature: HIJSMM301B5DY3.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcacc

SEQ ID NO: 569539 - DNA, 519 bp, Homo sapiens
  misc_feature: HIJSMM301CI3OH.48.55.E11.1.454.light.4.raw
agtatacatacacgaccggtgctcgatttagcactcgcacgttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcgagggaccaaactgaccgtcctgggtcagcccaaggctgccccctcggtcactctgttcccgccctcctcta

SEQ ID NO: 569540 - DNA, 483 bp, Homo sapiens
  misc_feature: HIJSMM301C3ORQ.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacaagagttacagtacccgtcggacgtcgtcgaggaccgaacgaggaaagtacaaacgaaacgtagtagtcgtgca

SEQ ID NO: 569541 - DNA, 491 bp, Homo sapiens; identical to SEQ ID NO: 539402
  misc_feature: HIJSMM301BM0M3.13.5.A05.1.454.light.4.raw

SEQ ID NO: 569542 - DNA, 389 bp, Homo sapiens; identical to SEQ ID NO: 561342
  misc_feature: HIJSMM301A3N9T.12.6.A06.1.454.light.4.raw

SEQ ID NO: 569543 - DNA, 492 bp, Homo sapiens
  misc_feature: HIJSMM301DN5UY.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccgagggtaggaaatacaaacgaacctagtggcgtgcaccatcttcg

SEQ ID NO: 569544 - DNA, 487 bp, Homo sapiens
  misc_feature: HIJSMM301D2BIJ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtcctaggtcagcccaaggccaaccca

SEQ ID NO: 569545 - DNA, 499 bp, Homo sapiens
  misc_feature: HIJSMM301AMJKI.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacgtttcggcggagggaccgagggtggagatacaaacgaactgtggctgcaccatctgtcttcattccc

SEQ ID NO: 569546 - DNA, 489 bp, Homo sapiens; identical to SEQ ID NO: 535139
  misc_feature: HIJSMM301CPJHB.14.55.E11.1.454.light.4.raw

SEQ ID NO: 569547 - DNA, 478 bp, Homo sapiens
  misc_feature: HIJSMM301DB140.49.35.D02.1.454.light.4.raw
agtcgagagacacgaccggtgctcgatttagcacacgatagttgggtttggggagagctctggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccagggaccaagctggagatcaagcgaa

SEQ ID NO: 569548 - DNA, 473 bp, Homo sapiens; identical to SEQ ID NO: 538060
  misc_feature: HIJSMM301BNW4B.18.76.G10.1.454.light.4.raw

SEQ ID NO: 569549 - DNA, 499 bp, Homo sapiens; identical to SEQ ID NO: 537800
  misc_feature: HIJSMM301EAWQW.22.38.D05.1.454.light.4.raw

SEQ ID NO: 569550 - DNA, 505 bp, Homo sapiens; identical to SEQ ID NO: 535503
  misc_feature: HIJSMM301BKZXQ.8.28.C06.1.454.light.4.raw

SEQ ID NO: 569551 - DNA, 493 bp, Homo sapiens; identical to SEQ ID NO: 544835
  misc_feature: HIJSMM301ALJOP.43.29.C07.1.454.light.4.raw

SEQ ID NO: 569552 - DNA, 492 bp, Homo sapiens; identical to SEQ ID NO: 535126
  misc_feature: HIJSMM301AGLFX.18.11.A11.1.454.light.4.raw

SEQ ID NO: 569553 - DNA, 454 bp, Homo sapiens; identical to SEQ ID NO: 534964
  misc_feature: HIJSMM301AZCE6.19.86.H09.1.454.light.4.raw

SEQ ID NO: 569554 - DNA, 473 bp, Homo sapiens; identical to SEQ ID NO: 541472
  misc_feature: HIJSMM301DUAVB.5.12.B01.1.454.light.4.raw

SEQ ID NO: 569555 - DNA, 495 bp, Homo sapiens; identical to SEQ ID NO: 545900
  misc_feature: HIJSMM301BGMQR.11.59.F04.1.454.light.4.raw

SEQ ID NO: 569556 - DNA, 520 bp, Homo sapiens
  misc_feature: HIJSMM301A82A3.3.33.C11.1.454.light.4.raw
  modified_base (473)..(473): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaagcgcgtccgtccccgtccggtcnccttcgttccttaccccctcccttccgtacggtgtcgtcgtccttcg

SEQ ID NO: 569557 - DNA, 494 bp, Homo sapiens; identical to SEQ ID NO: 534992
  misc_feature: HIJSMM301C3BMT.9.1.A01.1.454.light.4.raw

SEQ ID NO: 569558 - DNA, 486 bp, Homo sapiens; identical to SEQ ID NO: 542999
  misc_feature: HIJSMM301CWRTG.17.55.E11.1.454.light.4.raw

SEQ ID NO: 569559 - DNA, 484 bp, Homo sapiens; identical to SEQ ID NO: 535400
  misc_feature: HIJSMM301DK4W4.46.26.C04.1.454.light.4.raw

SEQ ID NO: 569560 - DNA, 447 bp, Homo sapiens; identical to SEQ ID NO: 535020
  misc_feature: HIJSMM301CTGFW.18.9.A09.1.454.light.4.raw

SEQ ID NO: 569561 - DNA, 444 bp, Homo sapiens; identical to SEQ ID NO: 535027
  misc_feature: HIJSMM301BO35L.8.73.G07.1.454.light.4.raw

SEQ ID NO: 569562 - DNA, 485 bp, Homo sapiens
  misc_feature: HIJSMM301AEABP.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaagatattgcaacatattactgtcaacagtatcataatctccccacttcgcctcggacaagtggatatacaaacgaactagtggctgcaccactctgtt

SEQ ID NO: 569563 - DNA, 440 bp, Homo sapiens; identical to SEQ ID NO: 550374
  misc_feature: HIJSMM301A3C6F.41.9.A09.1.454.light.4.raw

SEQ ID NO: 569564 - DNA, 496 bp, Homo sapiens
  misc_feature: HIJSMM301E2Z40.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccgaaggtaggagagtcaaacgaactcgtggctgcaccactctgtt

SEQ ID NO: 569565 - DNA, 491 bp, Homo sapiens; identical to SEQ ID NO: 538021
  misc_feature: HIJSMM301CZ8VL.3.72.G06.1.454.light.4.raw

SEQ ID NO: 569566 - DNA, 520 bp, Homo sapiens
  misc_feature: HIJSMM301BLUK2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatggtggcagttttattactgtcaactagtttttctcggggcgttcggccgaacgggaccgaacgggtaggaaagtacaaaacgaacctaggtggctgcaccatctgtcttctatcttccccg

SEQ ID NO: 569567 - DNA, 501 bp, Homo sapiens
  misc_feature: HIJSMM301D6VG3.40.36.D03.1.454.light.4.raw
tctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatacaaacgaactagtggctgcacca

SEQ ID NO: 569568 - DNA, 479 bp, Homo sapiens; identical to SEQ ID NO: 537163
  misc_feature: HIJSMM301A7J74.13.73.G07.1.454.light.4.raw

SEQ ID NO: 569569 - DNA, 482 bp, Homo sapiens; identical to SEQ ID NO: 540521
  misc_feature: HIJSMM301AINYI.21.25.C03.1.454.light.4.raw

SEQ ID NO: 569570 - DNA, 487 bp, Homo sapiens
  misc_feature: HIJSMM301EEFUV.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggtagtttattactgcatgcaagctctacaaactcctctcactttcggcggagggaccaaggtggagatacaaacgaact

SEQ ID NO: 569571 - DNA, 486 bp, Homo sapiens; identical to SEQ ID NO: 536261
  misc_feature: HIJSMM301CQ408.26.55.E11.1.454.light.4.raw

SEQ ID NO: 569572 - DNA, 478 bp, Homo sapiens; identical to SEQ ID NO: 535129
  misc_feature: HIJSMM301EDGK1.11.11.A11.1.454.light.4.raw

SEQ ID NO: 569573 - DNA, 478 bp, Homo sapiens
  misc_feature: HIJSMM301CYCSX.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactaccctctcactttcgcggggacgaacggtggagatcaaacgaactagtggctgcaca

SEQ ID NO: 569574 - DNA, 514 bp, Homo sapiens
  misc_feature: HIJSMM301EQ7RV.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcgttcggcggagggaccaggctgaccgtcctaagtcagcccaaggctgccccctcggtcact

SEQ ID NO: 569575 - DNA, 422 bp, Homo sapiens; identical to SEQ ID NO: 539618
  misc_feature: HIJSMM301CUBDM.41.14.B03.1.454.light.4.raw

SEQ ID NO: 569576 - DNA, 486 bp, Homo sapiens; identical to SEQ ID NO: 543923
  misc_feature: HIJSMM301DNQP0.3.88.H11.1.454.light.4.raw

SEQ ID NO: 569577 - DNA, 447 bp, Homo sapiens; identical to SEQ ID NO: 535201
  misc_feature: HIJSMM301D6DB6.18.9.A09.1.454.light.4.raw

SEQ ID NO: 569578 - DNA, 445 bp, Homo sapiens
  misc_feature: HIJSMM301CRT4Z.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccgacacgcgag

SEQ ID NO: 569579 - DNA, 494 bp, Homo sapiens
  misc_feature: HIJSMM301E2Y3Q.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccaaggacggaggatcagacgaactagtggctgcaccactctgtcttcta

SEQ ID NO: 569580 - DNA, 488 bp, Homo sapiens
  misc_feature: HIJSMM301CID0F.19.71.G05.1.454.light.4.raw
  modified_base (482)..(482): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcanacggaa

SEQ ID NO: 569581 - DNA, 476 bp, Homo sapiens; identical to SEQ ID NO: 538026
  misc_feature: HIJSMM301AY7BV.13.76.G10.1.454.light.4.raw

SEQ ID NO: 569582 - DNA, 377 bp, Homo sapiens; identical to SEQ ID NO: 536071
  misc_feature: HIJSMM301BLEW3.40.9.A09.1.454.light.4.raw

SEQ ID NO: 569583 - DNA, 449 bp, Homo sapiens
  misc_feature: HIJSMM301E20C8.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctcccatactcgta

SEQ ID NO: 569584 - DNA, 521 bp, Homo sapiens
  misc_feature: HIJSMM301AVG31.41.35.D02.1.454.light.4.raw
tctatactatcacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctcgccccctcggcactctcgttcccg

SEQ ID NO: 569585 - DNA, 486 bp, Homo sapiens; identical to SEQ ID NO: 537617
  misc_feature: HIJSMM301EF559.10.53.E09.1.454.light.4.raw

SEQ ID NO: 569586 - DNA, 488 bp, Homo sapiens
  misc_feature: HIJSMM301BBPSZ.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagatttgcagtttattactgtcagcagtataataactggcctccggtcactttcggcggagggaccaaggtggagatcaaacgaactgtggctgcaccat

SEQ ID NO: 569587 - DNA, 496 bp, Homo sapiens; identical to SEQ ID NO: 536063
  misc_feature: HIJSMM301BUQ57.5.49.E05.1.454.light.4.raw

SEQ ID NO: 569588 - DNA, 460 bp, Homo sapiens; identical to SEQ ID NO: 537107
  misc_feature: HIJSMM301CCUYF.22.28.C06.1.454.light.4.raw

SEQ ID NO: 569589 - DNA, 508 bp, Homo sapiens
  misc_feature: HIJSMM301C5KW8.43.3.A03.1.454.light.4.raw
  modified_base (439)..(439): a, c, t, g, unknown or other
tgtgagtagtcacgaccggtgctcgatttagagagcgtcacaggggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtnttcggcggagggaccaggttgaccgtccttggtcagcccaaggctgccccctcggtcactctgttcccg

SEQ ID NO: 569590 - DNA, 508 bp, Homo sapiens; identical to SEQ ID NO: 536388
  misc_feature: HIJSMM301EDZF5.11.57.F02.1.454.light.4.raw

SEQ ID NO: 569591 - DNA, 447 bp, Homo sapiens; identical to SEQ ID NO: 535201
  misc_feature: HIJSMM301A7CLO.18.9.A09.1.454.light.4.raw

SEQ ID NO: 569592 - DNA, 488 bp, Homo sapiens
  misc_feature: HIJSMM301ASUR8.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaaacctgaagattttgcaacttactaactgtcaacagagttacggtaccccgtacactttggtccagggacgaaactaggacatcaaacgaactagtggctgcaccatct

SEQ ID NO: 569593 - DNA, 501 bp, Homo sapiens; identical to SEQ ID NO: 557427
  misc_feature: HIJSMM301CU2GB.17.27.C05.1.454.light.4.raw

SEQ ID NO: 569594 - DNA, 503 bp, Homo sapiens; identical to SEQ ID NO: 535044
  misc_feature: HIJSMM301C9HEB.19.78.H01.1.454.light.4.raw

SEQ ID NO: 569595 - DNA, 502 bp, Homo sapiens
  misc_feature: HIJSMM301B3WG4.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactagtggctgcaccatctgtcttcactcttcccg

SEQ ID NO: 569596 - DNA, 496 bp, Homo sapiens; identical to SEQ ID NO: 536690
  misc_feature: HIJSMM301A4TCJ.40.23.C01.1.454.light.4.raw

SEQ ID NO: 569597 - DNA, 476 bp, Homo sapiens
  misc_feature: HIJSMM301BWK8M.26.72.G06.1.454.light.4.raw
  modified_base (346)..(346): a, c, t, g, unknown or other
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagngatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 569598 - DNA, 488 bp, Homo sapiens; identical to SEQ ID NO: 537260
  misc_feature: HIJSMM301BVN4R.47.70.G04.1.454.light.4.raw

SEQ ID NO: 569599 - DNA, 483 bp, Homo sapiens
  misc_feature: HIJSMM301EALTF.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattgctgtcagcagtataataactggtggacgttcggccaagggaccaaggtagaaatcaaacgaactgtggctgcaccat

SEQ ID NO: 569600 - DNA, 497 bp, Homo sapiens
  misc_feature: HIJSMM301EJ62O.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctccgagtagtaca

SEQ ID NO: 569601 - DNA, 446 bp, Homo sapiens; identical to SEQ ID NO: 541726
  misc_feature: HIJSMM301DBH77.18.9.A09.1.454.light.4.raw

SEQ ID NO: 569602 - DNA, 506 bp, Homo sapiens; identical to SEQ ID NO: 554661
  misc_feature: HIJSMM301BTSX6.3.79.H02.1.454.light.4.raw

SEQ ID NO: 569603 - DNA, 503 bp, Homo sapiens
  misc_feature: HIJSMM301CGXVP.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccctcc

SEQ ID NO: 569604 - DNA, 513 bp, Homo sapiens
  misc_feature: HIJSMM301BAMS5.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacgttcggcccgtcgggaccgaaaggtaggatatacaaacgaactcgtggctgcaccatctgtctt

SEQ ID NO: 569605 - DNA, 498 bp, Homo sapiens; identical to SEQ ID NO: 535974
  misc_feature: HIJSMM301D0T32.22.27.C05.1.454.light.4.raw

SEQ ID NO: 569606 - DNA, 512 bp, Homo sapiens
  misc_feature: HIJSMM301CB7WM.49.35.D02.1.454.light.4.raw
agtcgagagacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccgccct

SEQ ID NO: 569607 - DNA, 485 bp, Homo sapiens
  misc_feature: HIJSMM301B0EOS.48.22.B11.1.454.light.4.raw
agtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtcttcta

SEQ ID NO: 569608 - DNA, 487 bp, Homo sapiens
  misc_feature: HIJSMM301C8K6X.3.55.E11.1.454.light.4.raw
  modified_base (473)..(473): a, c, t, g, unknown or other
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaaggtagaaatcaaacgaaactntggctgcaccatct

SEQ ID NO: 569609 - DNA, 504 bp, Homo sapiens; identical to SEQ ID NO: 542288
  misc_feature: HIJSMM301ANTQK.8.28.C06.1.454.light.4.raw

SEQ ID NO: 569610 - DNA, 492 bp, Homo sapiens
  misc_feature: HIJSMM301EXP6L.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctcatccctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcaccatctgtcttcat

SEQ ID NO: 569611 - DNA, 502 bp, Homo sapiens
  misc_feature: HIJSMM301DG5CR.4.39.D06.1.454.light.4.raw
agcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctgccccctc

SEQ ID NO: 569612 - DNA, 503 bp, Homo sapiens
  misc_feature: HIJSMM301AINR6.18.26.C04.1.454.light.4.raw
tacgagtatgcacgaccggtgctcgatttagtctagcgactttggggtttgggggggtcgagacccagtcgggacacagcatggacatgagggtccccgcctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgcc

SEQ ID NO: 569613 - DNA, 488 bp, Homo sapiens; identical to SEQ ID NO: 539884
  misc_feature: HIJSMM301A6MD0.7.85.H08.1.454.light.4.raw

SEQ ID NO: 569614 - DNA, 482 bp, Homo sapiens; identical to SEQ ID NO: 537424
  misc_feature: HIJSMM301BWB31.4.39.D06.1.454.light.4.raw

SEQ ID NO: 569615 - DNA, 487 bp, Homo sapiens
  misc_feature: HIJSMM301CJ9G7.48.27.C05.1.454.light.4.raw
agtatacatacacgaccggtgctcgatttagacgcgatcgaagggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcagaccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaagctgacagtcctaggtcagcccaaggctcg

SEQ ID NO: 569616 - DNA, 519 bp, Homo sapiens
  misc_feature: HIJSMM301C65DZ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctggccccctcggtcactctgttcccgccctcctccacg

SEQ ID NO: 569617 - DNA, 519 bp, Homo sapiens
  misc_feature: HIJSMM301DCOMB.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttgggctttcggcggaggactaagttgaccgtcctacgtcagcccaaggctgccccctcggtcta

SEQ ID NO: 569618 - DNA, 497 bp, Homo sapiens
  misc_feature: HIJSMM301AYT0Q.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaacgggaccgaaacgtaggacgatcaagcgaactagtggctgcaccatctgt

SEQ ID NO: 569619 - DNA, 483 bp, Homo sapiens
  misc_feature: HIJSMM301DM0MZ.48.35.D02.1.454.light.4.raw
agtatacatacacgaccggtgctcgatttagcacacgatagttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaagtcaaacgaactagtggctgcaca

SEQ ID NO: 569620 - DNA, 520 bp, Homo sapiens; identical to SEQ ID NO: 535686
  misc_feature: HIJSMM301BPEGX.41.19.B08.1.454.light.4.raw

SEQ ID NO: 569621 - DNA, 495 bp, Homo sapiens
  misc_feature: HIJSMM301DUBJK.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgttacacttttggccaggggacccaggtggagatcagacgaactgtggctgcaccatctgtcttcatcttcccg

SEQ ID NO: 569622 - DNA, 506 bp, Homo sapiens; identical to SEQ ID NO: 555171
  misc_feature: HIJSMM301ATG4K.5.24.C02.1.454.light.4.raw

SEQ ID NO: 569623 - DNA, 501 bp, Homo sapiens
  misc_feature: HIJSMM301AXK9O.17.21.B10.1.454.light.4.raw
  modified_base (466)..(466): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcaggtggaggctgaggatgtcggggttactactgcatgcagggtacactctggccgttcacttttggccagggggaccaaaacgnggtagtagtacacgaacgaaactgtgggctggcaa

SEQ ID NO: 569624 - DNA, 494 bp, Homo sapiens
  misc_feature: HIJSMM301CDP6M.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaacgaactgtggctgcaccatctgtcttcatt

SEQ ID NO: 569625 - DNA, 503 bp, Homo sapiens; identical to SEQ ID NO: 535140
  misc_feature: HIJSMM301DVWXZ.18.37.D04.1.454.light.4.raw

SEQ ID NO: 569626 - DNA, 510 bp, Homo sapiens; identical to SEQ ID NO: 535376
  misc_feature: HIJSMM301C6326.17.33.C11.1.454.light.4.raw

SEQ ID NO: 569627 - DNA, 519 bp, Homo sapiens
  misc_feature: HIJSMM301CWR57.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccgcct

SEQ ID NO: 569628 - DNA, 494 bp, Homo sapiens
  misc_feature: HIJSMM301BYC6S.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggccagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 569629 - DNA, 484 bp, Homo sapiens; identical to SEQ ID NO: 535441
  misc_feature: HIJSMM301BU61U.26.60.F05.1.454.light.4.raw

SEQ ID NO: 569630 - DNA, 502 bp, Homo sapiens; identical to SEQ ID NO: 541971
  misc_feature: HIJSMM301C0TE4.4.39.D06.1.454.light.4.raw

SEQ ID NO: 569631 - DNA, 520 bp, Homo sapiens; identical to SEQ ID NO: 546048
  misc_feature: HIJSMM301BI2W6.27.23.C01.1.454.light.4.raw

SEQ ID NO: 569632 - DNA, 496 bp, Homo sapiens; identical to SEQ ID NO: 537513
  misc_feature: HIJSMM301EBMC5.12.87.H10.1.454.light.4.raw

SEQ ID NO: 569633 - DNA, 496 bp, Homo sapiens
  misc_feature: HIJSMM301EKJ69.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctcgggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccat

SEQ ID NO: 569634 - DNA, 497 bp, Homo sapiens; identical to SEQ ID NO: 538030
  misc_feature: HIJSMM301DWZ98.40.23.C01.1.454.light.4.raw

SEQ ID NO: 569635 - DNA, 495 bp, Homo sapiens; identical to SEQ ID NO: 539267
  misc_feature: HIJSMM301CG0T4.21.27.C05.1.454.light.4.raw

SEQ ID NO: 569636 - DNA, 501 bp, Homo sapiens
  misc_feature: HIJSMM301DL1K6.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaa

SEQ ID NO: 569637 - DNA, 478 bp, Homo sapiens; identical to SEQ ID NO: 544068
  misc_feature: HIJSMM301B597V.13.59.F04.1.454.light.4.raw

SEQ ID NO: 569638 - DNA, 478 bp, Homo sapiens; identical to SEQ ID NO: 535129
  misc_feature: HIJSMM301BLNUZ.11.11.A11.1.454.light.4.raw

SEQ ID NO: 569639 - DNA, 495 bp, Homo sapiens
  misc_feature: HIJSMM301DZRVR.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattctactttcggccctgggaccaaagtggatttcagacgaactgtggctgcaccatctgtcttcta

SEQ ID NO: 569640 - DNA, 495 bp, Homo sapiens; identical to SEQ ID NO: 568821
  misc_feature: HIJSMM301B75Z6.27.78.H01.1.454.light.4.raw

SEQ ID NO: 569641 - DNA, 488 bp, Homo sapiens
  misc_feature: HIJSMM301BNCN6.43.28.C06.1.454.light.4.raw
tgtgagtagtcacgaccggtgctcgatttagagctcacgtattgggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattacttgcatgcaagggacacactggccgtacacttttggccaggggccaagctggagatcaaacgaa

SEQ ID NO: 569642 - DNA, 444 bp, Homo sapiens; identical to SEQ ID NO: 535192
  misc_feature: HIJSMM301A8CX4.5.9.A09.1.454.light.4.raw

SEQ ID NO: 569643 - DNA, 472 bp, Homo sapiens; identical to SEQ ID NO: 562597
  misc_feature: HIJSMM301B8Z33.3.38.D05.1.454.light.4.raw

SEQ ID NO: 569644 - DNA, 498 bp, Homo sapiens
  misc_feature: HIJSMM301BYSY7.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccgacggaccgaaggtggaaatacaaacgaaactgtggctgcaccatctgtctt

SEQ ID NO: 569645 - DNA, 492 bp, Homo sapiens
  misc_feature: HIJSMM301D8NPL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactgtgctgcaccatctgtctt

SEQ ID NO: 569646 - DNA, 488 bp, Homo sapiens; identical to SEQ ID NO: 536861
  misc_feature: HIJSMM301DA60O.12.88.H11.1.454.light.4.raw

SEQ ID NO: 569647 - DNA, 497 bp, Homo sapiens; identical to SEQ ID NO: 534982
  misc_feature: HIJSMM301EGTH3.26.80.H03.1.454.light.4.raw

SEQ ID NO: 569648 - DNA, 480 bp, Homo sapiens; identical to SEQ ID NO: 535630
  misc_feature: HIJSMM301BLE0S.40.59.F04.1.454.light.4.raw

SEQ ID NO: 569649 - DNA, 496 bp, Homo sapiens; identical to SEQ ID NO: 551939
  misc_feature: HIJSMM301BZ345.19.71.G05.1.454.light.4.raw

SEQ ID NO: 569650 - DNA, 493 bp, Homo sapiens; identical to SEQ ID NO: 535657
  misc_feature: HIJSMM301AJOSJ.27.78.H01.1.454.light.4.raw

SEQ ID NO: 569651 - DNA, 484 bp, Homo sapiens; identical to SEQ ID NO: 535240
  misc_feature: HIJSMM301BOIOW.47.60.F05.1.454.light.4.raw

SEQ ID NO: 569652 - DNA, 485 bp, Homo sapiens; identical to SEQ ID NO: 536799
  misc_feature: HIJSMM301D6HU9.19.71.G05.1.454.light.4.raw

SEQ ID NO: 569653 - DNA, 484 bp, Homo sapiens
  misc_feature: HIJSMM301CE37I.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggagggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgtt

SEQ ID NO: 569654 - DNA, 494 bp, Homo sapiens
  misc_feature: HIJSMM301BHPSB.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggccaagctgaccgtcctgggtcagcccaaggctgccccctcggtcactc

SEQ ID NO: 569655 - DNA, 508 bp, Homo sapiens
  misc_feature: HIJSMM301C0JRQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcccgtcgggaccgaaagtggatatcaaacgaactgtggctgcaccatctgtctt

SEQ ID NO: 569656 - DNA, 495 bp, Homo sapiens; identical to SEQ ID NO: 539509
  misc_feature: HIJSMM301AGBTC.26.72.G06.1.454.light.4.raw

SEQ ID NO: 569657 - DNA, 488 bp, Homo sapiens
  misc_feature: HIJSMM301EUS8Y.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgaccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaaattatcctgggacgttcggccaaacgggaccgaaggttaggaaatcaaacgaaactcgtgg

SEQ ID NO: 569658 - DNA, 481 bp, Homo sapiens
  misc_feature: HIJSMM301DYAWF.7.76.G10.1.454.light.4.raw
cgtgtctctacacgaccggtgctcgatttagtcactcatacagggggcgaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcaccat

SEQ ID NO: 569659 - DNA, 504 bp, Homo sapiens
  misc_feature: HIJSMM301BXCCT.48.78.H01.1.454.light.4.raw
agtatacatacacgaccggtgctcgatttagtgtgagtagtttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 569660 - DNA, 487 bp, Homo sapiens
  misc_feature: HIJSMM301A6X0Q.52.3.A03.1.454.light.4.raw
cgcagtacgacacgaccggtgctcgatttagagagcgtcacaggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataacagttttcattcacttttggccctgggacgacagtggatatcaaacgaactgtggctgcaccatctgtcttcta

SEQ ID NO: 569661 - DNA, 508 bp, Homo sapiens
  misc_feature: HIJSMM301DZNNA.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttccca

SEQ ID NO: 569662 - DNA, 509 bp, Homo sapiens
  misc_feature: HIJSMM301BF07F.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccatgtcactctcg

SEQ ID NO: 569663 - DNA, 493 bp, Homo sapiens
  misc_feature: HIJSMM301EM1N5.48.41.D08.1.454.light.4.raw
agtatacatacacgaccggtgctcgatttagtcacgcgagaaagggaaagggggagtcagacccagtcaggacacagcatggacatgagggtccccgctcagctcctggggctcctgctgctctggctcccaggtgccaaatgtgacatccagatgacccagtctccttccaccctgtctgcctctgtaggagacagggtcaccatcacttgccgggccagtcagagtattagtgactggttggcctggtatcagcagaaaccagggaaagcccctaacctcctgatctatcaggcatctactttagaaagtggggtcccatcaaggttcagcggcagtggatctgaaacagaattcactctcaccatcagcagcctgcagcctgatgattatgcgacttattactgccaacaatacactagtttgtggacgttcggccaggggaccaaggtggaaatcaaacgaaactgtggctgcaccatctgtcttcatt

SEQ ID NO: 569664 - DNA, 491 bp, Homo sapiens
  misc_feature: HIJSMM301BYXVG.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaa

SEQ ID NO: 569665 - DNA, 505 bp, Homo sapiens
  misc_feature: HIJSMM301C1PZT.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacggggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggtttcctcttttcaagatattcggcggagggaccaggctgaccgtcctgagtcagcccaaggctgccccctc

SEQ ID NO: 569666 - DNA, 487 bp, Homo sapiens; identical to SEQ ID NO: 536206
  misc_feature: HIJSMM301B85YG.47.38.D05.1.454.light.4.raw

SEQ ID NO: 569667 - DNA, 485 bp, Homo sapiens
  misc_feature: HIJSMM301A12MK.40.12.B01.1.454.light.4.raw
tctagcgactcacgaccggtgctcgatttagtagtgtagattccgcggggtgactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaa

SEQ ID NO: 569668 - DNA, 494 bp, Homo sapiens; identical to SEQ ID NO: 535680
  misc_feature: HIJSMM301ELZE3.16.78.H01.1.454.light.4.raw

SEQ ID NO: 569669 - DNA, 484 bp, Homo sapiens; identical to SEQ ID NO: 535211
  misc_feature: HIJSMM301DA75A.47.46.E02.1.454.light.4.raw

SEQ ID NO: 569670 - DNA, 487 bp, Homo sapiens; identical to SEQ ID NO: 542705
  misc_feature: HIJSMM301AKB6N.12.88.H11.1.454.light.4.raw

SEQ ID NO: 569671 - DNA, 503 bp, Homo sapiens; identical to SEQ ID NO: 538884
  misc_feature: HIJSMM301ES63S.27.78.H01.1.454.light.4.raw

SEQ ID NO: 569672 - DNA, 488 bp, Homo sapiens; identical to SEQ ID NO: 535568
  misc_feature: HIJSMM301DOST0.21.4.A04.1.454.light.4.raw

SEQ ID NO: 569673 - DNA, 485 bp, Homo sapiens; identical to SEQ ID NO: 535985
  misc_feature: HIJSMM301B7AZP.15.1.A01.1.454.light.4.raw

SEQ ID NO: 569674 - DNA, 484 bp, Homo sapiens
  misc_feature: HIJSMM301A98KO.40.59.F04.1.454.light.4.raw
tctagcgactcacgaccggtgctcgatttagtacacacacttagggagttcggggggcctccaggaagcagcatcggaggtggcctcagccatggcatggatccctctcttcctcggcgtccttgcttactgcacaggctccgtggcctcctatgacttgactcacgccaccctcagtgtccgtgtccccaggaccagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaagg

SEQ ID NO: 569675 - DNA, 491 bp, Homo sapiens; identical to SEQ ID NO: 538238
  misc_feature: HIJSMM301ELSDI.26.78.H01.1.454.light.4.raw

SEQ ID NO: 569676 - DNA, 454 bp, Homo sapiens; identical to SEQ ID NO: 534964
  misc_feature: HIJSMM301DIF7P.19.86.H09.1.454.light.4.raw

SEQ ID NO: 569677 - DNA, 501 bp, Homo sapiens
  misc_feature: HIJSMM301DSZOL.41.35.D02.1.454.light.4.raw
tctatactatcacgaccggtgctcgatttagcacacgatagttgggtttgggggtgctcgattagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaacgaa

SEQ ID NO: 569678 - DNA, 495 bp, Homo sapiens
  misc_feature: HIJSMM301C3X74.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggaggaccgaaggtggagatcaaacgaactgtggctgcaccatctgtctt

SEQ ID NO: 569679 - DNA, 445 bp, Homo sapiens
  misc_feature: HIJSMM301C2O4I.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccaccctcctcgtactagaca

SEQ ID NO: 569680 - DNA, 490 bp, Homo sapiens; identical to SEQ ID NO: 538999
  misc_feature: HIJSMM301AD38S.16.86.H09.1.454.light.4.raw

SEQ ID NO: 569681 - DNA, 482 bp, Homo sapiens; identical to SEQ ID NO: 567744
  misc_feature: HIJSMM301A3RCY.41.47.E03.1.454.light.4.raw

SEQ ID NO: 569682 - DNA, 505 bp, Homo sapiens; identical to SEQ ID NO: 535503
  misc_feature: HIJSMM301E0F8N.8.28.C06.1.454.light.4.raw

SEQ ID NO: 569683 - DNA, 497 bp, Homo sapiens; identical to SEQ ID NO: 538030
  misc_feature: HIJSMM301A2VHJ.40.23.C01.1.454.light.4.raw

SEQ ID NO: 569684 - DNA, 486 bp, Homo sapiens; identical to SEQ ID NO: 536323
  misc_feature: HIJSMM301EPIG3.10.2.A02.1.454.light.4.raw

SEQ ID NO: 569685 - DNA, 491 bp, Homo sapiens
  misc_feature: HIJSMM301EZRG8.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacggccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactgt

SEQ ID NO: 569686 - DNA, 495 bp, Homo sapiens; identical to SEQ ID NO: 535007
  misc_feature: HIJSMM301C8SNF.22.5.A05.1.454.light.4.raw

SEQ ID NO: 569687 - DNA, 473 bp, Homo sapiens; identical to SEQ ID NO: 536941
  misc_feature: HIJSMM301AKIMX.3.38.D05.1.454.light.4.raw

SEQ ID NO: 569688 - DNA, 510 bp, Homo sapiens
  misc_feature: HIJSMM301ETMLS.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccacct

SEQ ID NO: 569689 - DNA, 447 bp, Homo sapiens; identical to SEQ ID NO: 535201
  misc_feature: HIJSMM301AGE1G.18.9.A09.1.454.light.4.raw

SEQ ID NO: 569690 - DNA, 508 bp, Homo sapiens
  misc_feature: HIJSMM301DA6MS.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggccaacccactgtcactctgtt

SEQ ID NO: 569691 - DNA, 503 bp, Homo sapiens; identical to SEQ ID NO: 535140
  misc_feature: HIJSMM301CSMW8.18.37.D04.1.454.light.4.raw

SEQ ID NO: 569692 - DNA, 486 bp, Homo sapiens
  misc_feature: HIJSMM301DGWMV.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttcccgccctcctcgtactagacg

SEQ ID NO: 569693 - DNA, 512 bp, Homo sapiens
  misc_feature: HIJSMM301BT71F.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaacggtaggaaagtacaaacgaactagtggctgtcaccactctgtcttctatcttccccg

SEQ ID NO: 569694 - DNA, 485 bp, Homo sapiens; identical to SEQ ID NO: 538533
  misc_feature: HIJSMM301BQ9GT.47.78.H01.1.454.light.4.raw

SEQ ID NO: 569695 - DNA, 493 bp, Homo sapiens; identical to SEQ ID NO: 535548
  misc_feature: HIJSMM301CE57J.51.81.H04.1.454.light.4.raw

SEQ ID NO: 569696 - DNA, 507 bp, Homo sapiens; identical to SEQ ID NO: 535455
  misc_feature: HIJSMM301AW9YF.8.28.C06.1.454.light.4.raw

SEQ ID NO: 569697 - DNA, 485 bp, Homo sapiens
  misc_feature: HIJSMM301A3YS0.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccgaagctgaccgtcctaggtcagaccccg

SEQ ID NO: 569698 - DNA, 486 bp, Homo sapiens
  misc_feature: HIJSMM301DNJDC.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactggtgctgcaccat

SEQ ID NO: 569699 - DNA, 493 bp, Homo sapiens
  misc_feature: HIJSMM301CT26O.13.11.A11.1.454.light.4.raw
tcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcatcta

SEQ ID NO: 569700 - DNA, 497 bp, Homo sapiens; identical to SEQ ID NO: 538296
  misc_feature: HIJSMM301BJAYG.18.11.A11.1.454.light.4.raw

SEQ ID NO: 569701 - DNA, 509 bp, Homo sapiens; identical to SEQ ID NO: 539269
  misc_feature: HIJSMM301DWL84.4.57.F02.1.454.light.4.raw

SEQ ID NO: 569702 - DNA, 510 bp, Homo sapiens
  misc_feature: HIJSMM301B1Q34.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccccactgtcactctcgttcccg

SEQ ID NO: 569703 - DNA, 502 bp, Homo sapiens; identical to SEQ ID NO: 543913
  misc_feature: HIJSMM301EOMJ0.18.26.C04.1.454.light.4.raw

SEQ ID NO: 569704 - DNA, 477 bp, Homo sapiens
  misc_feature: HIJSMM301BRCNC.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcacc

SEQ ID NO: 569705 - DNA, 512 bp, Homo sapiens
  misc_feature: HIJSMM301ASSTF.17.33.C11.1.454.light.4.raw
cgtagactagcacgaccggtgctcgatttagagtgagctcgttgggtttgggggcgccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaggactgccccctcggtcactctgttccgccctcct

SEQ ID NO: 569706 - DNA, 502 bp, Homo sapiens; identical to SEQ ID NO: 536253
  misc_feature: HIJSMM301BVY0R.21.22.B11.1.454.light.4.raw

SEQ ID NO: 569707 - DNA, 455 bp, Homo sapiens
  misc_feature: HIJSMM301BPRWD.19.86.H09.1.454.light.4.raw
tactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 569708 - DNA, 463 bp, Homo sapiens
  misc_feature: HIJSMM301BF0G3.49.8.A08.1.454.light.4.raw
agtcgagagacacgaccggtgctcgatttagcatactctacaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatcgtctcccgctcactttcggcgggggaccgaaggtggagatcaagcgaactgtgg

SEQ ID NO: 569709 - DNA, 501 bp, Homo sapiens; identical to SEQ ID NO: 555551
  misc_feature: HIJSMM301BDKR5.21.81.H04.1.454.light.4.raw

SEQ ID NO: 569710 - DNA, 485 bp, Homo sapiens; identical to SEQ ID NO: 536630
  misc_feature: HIJSMM301AOJJM.13.56.F01.1.454.light.4.raw

SEQ ID NO: 569711 - DNA, 486 bp, Homo sapiens; identical to SEQ ID NO: 561057
  misc_feature: HIJSMM301D2IIB.4.33.C11.1.454.light.4.raw

SEQ ID NO: 569712 - DNA, 524 bp, Homo sapiens
  misc_feature: HIJSMM301D6U0T.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtaactctgttcccgccctcct

SEQ ID NO: 569713 - DNA, 512 bp, Homo sapiens
  misc_feature: HIJSMM301BH7KV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagtttttctcgggcgttcggccgaagggaccgaaggtaggaaagtacaaacgaaactagtggctgcaccatctgtcttctatcttccccg

SEQ ID NO: 569714 - DNA, 502 bp, Homo sapiens
  misc_feature: HIJSMM301EROTQ.41.87.H10.1.454.light.4.raw
tctatactatcacgaccggtgctcgatttagcagtactgcgttgggtttggggactttgcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccaccctcctcatagtataga

SEQ ID NO: 569715 - DNA, 447 bp, Homo sapiens; identical to SEQ ID NO: 535020
  misc_feature: HIJSMM301C0CDM.18.9.A09.1.454.light.4.raw

SEQ ID NO: 569716 - DNA, 500 bp, Homo sapiens
  misc_feature: HIJSMM301D1ET9.40.45.E01.1.454.light.4.raw
tctagcgactcacgaccggtgctcgatttagtgagtcagtaagggaaaggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtcttcatcttccg

SEQ ID NO: 569717 - DNA, 478 bp, Homo sapiens
  misc_feature: HIJSMM301AG07G.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaaggtaggaggatcgaacgaactagtggctgcacc

SEQ ID NO: 569718 - DNA, 496 bp, Homo sapiens; identical to SEQ ID NO: 536248
  misc_feature: HIJSMM301BSVPL.22.27.C05.1.454.light.4.raw

SEQ ID NO: 569719 - DNA, 489 bp, Homo sapiens; identical to SEQ ID NO: 535139
  misc_feature: HIJSMM301B8SUQ.14.55.E11.1.454.light.4.raw

SEQ ID NO: 569720 - DNA, 485 bp, Homo sapiens; identical to SEQ ID NO: 536040
  misc_feature: HIJSMM301AHR6E.15.1.A01.1.454.light.4.raw

SEQ ID NO: 569721 - DNA, 508 bp, Homo sapiens
  misc_feature: HIJSMM301CUV5K.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctcgttcccacct

SEQ ID NO: 569722 - DNA, 488 bp, Homo sapiens; identical to SEQ ID NO: 537260
  misc_feature: HIJSMM301ERCIC.47.70.G04.1.454.light.4.raw

SEQ ID NO: 569723 - DNA, 492 bp, Homo sapiens; identical to SEQ ID NO: 545637
  misc_feature: HIJSMM301B49ZJ.48.1.A01.1.454.light.4.raw

SEQ ID NO: 569724 - DNA, 504 bp, Homo sapiens; identical to SEQ ID NO: 535077
  misc_feature: HIJSMM301ETE78.8.28.C06.1.454.light.4.raw

SEQ ID NO: 569725 - DNA, 500 bp, Homo sapiens; identical to SEQ ID NO: 547703
  misc_feature: HIJSMM301DSWZV.43.34.D01.1.454.light.4.raw

SEQ ID NO: 569726 - DNA, 515 bp, Homo sapiens
  misc_feature: HIJSMM301EJWMX.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagttagtattcatccgggggttttcggcggagggaccaagctgaccgtcctaggtcagcccaaggctgccccctcggtcactctcgttcccg

SEQ ID NO: 569727 - DNA, 494 bp, Homo sapiens; identical to SEQ ID NO: 545671
  misc_feature: HIJSMM301C6VWA.9.1.A01.1.454.light.4.raw

SEQ ID NO: 569728 - DNA, 445 bp, Homo sapiens; identical to SEQ ID NO: 557838
  misc_feature: HIJSMM301EH65O.2.76.G10.1.454.light.4.raw

SEQ ID NO: 569729 - DNA, 496 bp, Homo sapiens; identical to SEQ ID NO: 537681
  misc_feature: HIJSMM301AX9KA.40.23.C01.1.454.light.4.raw

SEQ ID NO: 569730 - DNA, 495 bp, Homo sapiens
  misc_feature: HIJSMM301D0RRN.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcgggaggaccaaggtggagatcaaacgaactgtggctgcaccatctgtctt

SEQ ID NO: 569731 - DNA, 493 bp, Homo sapiens
  misc_feature: HIJSMM301A4IOP.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcacatctgtctt

SEQ ID NO: 569732 - DNA, 486 bp, Homo sapiens; identical to SEQ ID NO: 537127
  misc_feature: HIJSMM301D0MFX.3.77.G11.1.454.light.4.raw

SEQ ID NO: 569733 - DNA, 506 bp, Homo sapiens; identical to SEQ ID NO: 538355
  misc_feature: HIJSMM301E16TV.10.27.C05.1.454.light.4.raw

SEQ ID NO: 569734 - DNA, 515 bp, Homo sapiens
  misc_feature: HIJSMM301AR5CU.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgctagtttactactgtcagcagtatgttaccgtccccgtggacgttcgcgaggaccaaggtgcaatcaaccgaactgtggctgcaccatctgtcttcatctccccg

SEQ ID NO: 569735 - DNA, 515 bp, Homo sapiens
  misc_feature: HIJSMM301CXWDP.17.28.C06.1.454.light.4.raw
cgtagactagcacgaccggtgctcgatttagagctcacgtattgggtttgggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgatggtccggtgttcggcggaggaccaggctgaccgtctaagtcagcccaaggctcgccccctcggtcactctcgttcccaccct

SEQ ID NO: 569736 - DNA, 495 bp, Homo sapiens
  misc_feature: HIJSMM301CRR5Z.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgtaacg

SEQ ID NO: 569737 - DNA, 521 bp, Homo sapiens; identical to SEQ ID NO: 538715
  misc_feature: HIJSMM301D8GM8.27.23.C01.1.454.light.4.raw

SEQ ID NO: 569738 - DNA, 515 bp, Homo sapiens
  misc_feature: HIJSMM301DYS5I.14.19.B08.1.454.light.4.raw
  modified_base (506)..(506): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccnccctcctcg

SEQ ID NO: 569739 - DNA, 486 bp, Homo sapiens
  misc_feature: HIJSMM301DQX7H.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcacgtcttgagtcagcccaagccaa

SEQ ID NO: 569740 - DNA, 493 bp, Homo sapiens; identical to SEQ ID NO: 540127
  misc_feature: HIJSMM301B5QD4.10.17.B06.1.454.light.4.raw

SEQ ID NO: 569741 - DNA, 497 bp, Homo sapiens
  misc_feature: HIJSMM301C5GKY.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcta

SEQ ID NO: 569742 - DNA, 519 bp, Homo sapiens
  misc_feature: HIJSMM301BLW1W.40.46.E02.1.454.light.4.raw
tctagcgactcacgaccggtgctcgatttagactcatctacagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 569743 - DNA, 491 bp, Homo sapiens
  misc_feature: HIJSMM301A6LE3.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcgccaaggaccgaaggtggaatacaaacgaactagtggctgcaccatctgtt

SEQ ID NO: 569744 - DNA, 490 bp, Homo sapiens; identical to SEQ ID NO: 542820
  misc_feature: HIJSMM301ESG62.11.12.B01.1.454.light.4.raw

SEQ ID NO: 569745 - DNA, 503 bp, Homo sapiens
  misc_feature: HIJSMM301BR75X.43.69.G03.1.454.light.4.raw
tgtgagtagtcacgaccggtgctcgatttagtcgctgcgtaaaggagaaagggcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggacaac

SEQ ID NO: 569746 - DNA, 506 bp, Homo sapiens; identical to SEQ ID NO: 538849
  misc_feature: HIJSMM301C4IFI.43.15.B04.1.454.light.4.raw

SEQ ID NO: 569747 - DNA, 498 bp, Homo sapiens
  misc_feature: HIJSMM301B6RM4.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactaggtggctgcaccatctgttcttcatccttccccg

SEQ ID NO: 569748 - DNA, 446 bp, Homo sapiens
  misc_feature: HIJSMM301CMG8Z.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggaggggaccaagctgaccgtcctaggtcagcccaaggctgccccctcggtcactctgtttcccgccctcctcagacgtatca

SEQ ID NO: 569749 - DNA, 512 bp, Homo sapiens; identical to SEQ ID NO: 539813
  misc_feature: HIJSMM301A4WEW.14.7.A07.1.454.light.4.raw

SEQ ID NO: 569750 - DNA, 489 bp, Homo sapiens; identical to SEQ ID NO: 535139
  misc_feature: HIJSMM301EO49I.14.55.E11.1.454.light.4.raw

SEQ ID NO: 569751 - DNA, 496 bp, Homo sapiens; identical to SEQ ID NO: 535109
  misc_feature: HIJSMM301BTO5K.16.78.H01.1.454.light.4.raw

SEQ ID NO: 569752 - DNA, 502 bp, Homo sapiens; identical to SEQ ID NO: 542039
  misc_feature: HIJSMM301AVSX7.2.76.G10.1.454.light.4.raw

SEQ ID NO: 569753 - DNA, 484 bp, Homo sapiens; identical to SEQ ID NO: 535400
  misc_feature: HIJSMM301D2H8O.46.26.C04.1.454.light.4.raw

SEQ ID NO: 569754 - DNA, 417 bp, Homo sapiens; identical to SEQ ID NO: 568651
  misc_feature: HIJSMM301CWII4.19.86.H09.1.454.light.4.raw

SEQ ID NO: 569755 - DNA, 487 bp, Homo sapiens
  misc_feature: HIJSMM301A4ZS5.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgggctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccca

SEQ ID NO: 569756 - DNA, 498 bp, Homo sapiens
  misc_feature: HIJSMM301BKWOF.48.68.G02.1.454.light.4.raw
agtatacatacacgaccggtgctcgatttagtcgatagtgaagggaaaggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttcccgt

SEQ ID NO: 569757 - DNA, 495 bp, Homo sapiens
  misc_feature: HIJSMM301BG11M.49.33.C11.1.454.light.4.raw
  modified_base (482)..(482): a, c, t, g, unknown or other
agtcgagagacacgaccggtgctcgatttagagtgagctcgttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtaggagagtcaaacgaactagtggntgcaccatctgtt

SEQ ID NO: 569758 - DNA, 507 bp, Homo sapiens; identical to SEQ ID NO: 535930
  misc_feature: HIJSMM301D2GWJ.15.34.D01.1.454.light.4.raw

SEQ ID NO: 569759 - DNA, 501 bp, Homo sapiens
  misc_feature: HIJSMM301CM2YY.18.59.F04.1.454.light.4.raw
  modified_base (417)..(417): a, c, t, g, unknown or other
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattacngcagctcatatacaagcaccagcactctctatgtcttcggaactgggaccaaggtcaccgtctaggtcagcccaaggccaaccc

SEQ ID NO: 569760 - DNA, 519 bp, Homo sapiens
  misc_feature: HIJSMM301AY3B6.8.87.H10.1.454.light.4.raw
  modified_base (505)..(505): a, c, t, g, unknown or other
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttccccnccctcctcgacacg

SEQ ID NO: 569761 - DNA, 492 bp, Homo sapiens; identical to SEQ ID NO: 535426
  misc_feature: HIJSMM301CNTLV.47.78.H01.1.454.light.4.raw

SEQ ID NO: 569762 - DNA, 473 bp, Homo sapiens; identical to SEQ ID NO: 535262
  misc_feature: HIJSMM301CLVAU.8.67.G01.1.454.light.4.raw

SEQ ID NO: 569763 - DNA, 502 bp, Homo sapiens; identical to SEQ ID NO: 541971
  misc_feature: HIJSMM301D17WQ.4.39.D06.1.454.light.4.raw

SEQ ID NO: 569764 - DNA, 486 bp, Homo sapiens; identical to SEQ ID NO: 537617
  misc_feature: HIJSMM301ED2IS.10.53.E09.1.454.light.4.raw

SEQ ID NO: 569765 - DNA, 444 bp, Homo sapiens; identical to SEQ ID NO: 535411
  misc_feature: HIJSMM301CAGJ3.8.73.G07.1.454.light.4.raw

SEQ ID NO: 569766 - DNA, 496 bp, Homo sapiens
  misc_feature: HIJSMM301A8TNR.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgatccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccagggaccgaaggtggagatcaaacgaactagtggctgcaccatctgtcttcatcttccccg

SEQ ID NO: 569767 - DNA, 494 bp, Homo sapiens; identical to SEQ ID NO: 540110
  misc_feature: HIJSMM301EA46A.51.71.G05.1.454.light.4.raw

SEQ ID NO: 569768 - DNA, 501 bp, Homo sapiens
  misc_feature: HIJSMM301CXNQF.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtgtgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 569769 - DNA, 495 bp, Homo sapiens
  misc_feature: HIJSMM301CK8Q1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaaactgtggctgcaccatctgtcttcatcttccccg

SEQ ID NO: 569770 - DNA, 489 bp, Homo sapiens
  misc_feature: HIJSMM301DMJQB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaactccggggtccctgaccgattcagtggcagcgggtctgggacagatttcactctcaccatcagcagcctgcaggctgaagatgtggcagtttattattgtcaacaatattattatacttcgtggacgttcgggccaagggaccgaaggtggatatcagacgaa

SEQ ID NO: 569771 - DNA, 485 bp, Homo sapiens; identical to SEQ ID NO: 535606
  misc_feature: HIJSMM301A5PBB.47.46.E02.1.454.light.4.raw

SEQ ID NO: 569772 - DNA, 511 bp, Homo sapiens
  misc_feature: HIJSMM301AL9GM.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaacgtggaaatcaaacgaactagtggctgcaccatctgtcttcatcttcccgccat

SEQ ID NO: 569773 - DNA, 512 bp, Homo sapiens
  misc_feature: HIJSMM301D56RL.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccaccctcctcctagtctacg

SEQ ID NO: 569774 - DNA, 487 bp, Homo sapiens
  misc_feature: HIJSMM301E2RSN.11.12.B01.1.454.light.4.raw
cgagagataccacgaccggtgctcgatttagtagtgtagattccgcggggtgggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccc

SEQ ID NO: 569775 - DNA, 497 bp, Homo sapiens
  misc_feature: HIJSMM301BBMTC.8.75.G09.1.454.light.4.raw
ctcgcgtgtccacgaccggtgctcgatttagtatagacatcaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatcccttgttctggaagcagctccaacatcggaactaatactgtaaactggtaccagcaactcccaggaacggcccccaaactcctcatctatcatagtgatcagcggccctcaggggtccctgaccgattctctggctccaagtctgccacctcagcctccctggccatcagtgggctccagtctgaggatgaggctgattattactgtgcagcatgggatgacagcctgaatggcctggtattcggcggagggaccaaagtgaccgtcctaggtcagcccaaggctgccccctc

SEQ ID NO: 569776 - DNA, 520 bp, Homo sapiens; identical to SEQ ID NO: 563724
  misc_feature: HIJSMM301AYJA0.40.46.E02.1.454.light.4.raw

SEQ ID NO: 569777 - DNA, 513 bp, Homo sapiens; identical to SEQ ID NO: 568189
  misc_feature: HIJSMM301AS0VW.14.7.A07.1.454.light.4.raw

SEQ ID NO: 569778 - DNA, 505 bp, Homo sapiens
  misc_feature: HIJSMM301EGT0F.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcggattcgtctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctgccccctcggtcactctgttccccg

SEQ ID NO: 569779 - DNA, 492 bp, Homo sapiens; identical to SEQ ID NO: 538644
  misc_feature: HIJSMM301EDUU7.26.78.H01.1.454.light.4.raw

SEQ ID NO: 569780 - DNA, 509 bp, Homo sapiens; identical to SEQ ID NO: 548681
  misc_feature: HIJSMM301ADEO9.47.83.H06.1.454.light.4.raw

SEQ ID NO: 569781 - DNA, 447 bp, Homo sapiens; identical to SEQ ID NO: 535201
  misc_feature: HIJSMM301BSO3G.18.9.A09.1.454.light.4.raw

SEQ ID NO: 569782 - DNA, 524 bp, Homo sapiens
  misc_feature: HIJSMM301C5N2D.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggccaggctgaccgtcctaggtcagcccaaggctcgccccctcggtcactctcgtcccgaccctcc

SEQ ID NO: 569783 - DNA, 500 bp, Homo sapiens
  misc_feature: HIJSMM301ASKE2.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccgggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 569784 - DNA, 499 bp, Homo sapiens
  misc_feature: HIJSMM301BA0YH.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccta

SEQ ID NO: 569785 - DNA, 481 bp, Homo sapiens
  misc_feature: HIJSMM301BBQCI.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcgtggatctagggcagatttcactctcaccatcaatcacctgcaggctgaggattttgcaacttactactgtcagcaggctaacaggctgcccccaacttcggccaggggacacgactggagattaaacgaactgtggctgcaccatct

SEQ ID NO: 569786 - DNA, 486 bp, Homo sapiens; identical to SEQ ID NO: 542999
  misc_feature: HIJSMM301DY76J.17.55.E11.1.454.light.4.raw

SEQ ID NO: 569787 - DNA, 497 bp, Homo sapiens; identical to SEQ ID NO: 535286
  misc_feature: HIJSMM301D143U.18.59.F04.1.454.light.4.raw

SEQ ID NO: 569788 - DNA, 491 bp, Homo sapiens; identical to SEQ ID NO: 537135
  misc_feature: HIJSMM301BUV8Z.21.46.E02.1.454.light.4.raw

SEQ ID NO: 569789 - DNA, 484 bp, Homo sapiens; identical to SEQ ID NO: 535211
  misc_feature: HIJSMM301EMJO7.47.46.E02.1.454.light.4.raw

SEQ ID NO: 569790 - DNA, 495 bp, Homo sapiens; identical to SEQ ID NO: 564072
  misc_feature: HIJSMM301DZR2L.11.81.H04.1.454.light.4.raw

SEQ ID NO: 569791 - DNA, 496 bp, Homo sapiens; identical to SEQ ID NO: 535109
  misc_feature: HIJSMM301CKLWW.16.78.H01.1.454.light.4.raw

SEQ ID NO: 569792 - DNA, 501 bp, Homo sapiens
  misc_feature: HIJSMM301B8PGO.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgccccctcggtcacgtctgttccccg

SEQ ID NO: 569793 - DNA, 520 bp, Homo sapiens; identical to SEQ ID NO: 543998
  misc_feature: HIJSMM301BKBTU.27.23.C01.1.454.light.4.raw

SEQ ID NO: 569794 - DNA, 494 bp, Homo sapiens
  misc_feature: HIJSMM301BKC9F.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccagggaccaaggtggatatcagacgaactgtggctgca

SEQ ID NO: 569795 - DNA, 491 bp, Homo sapiens
  misc_feature: HIJSMM301CKUVE.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccagggaccaagctggagatcaaacgaactgtgg

SEQ ID NO: 569796 - DNA, 492 bp, Homo sapiens
  misc_feature: HIJSMM301AG3TA.13.5.A05.1.454.light.4.raw
  modified_base (430)..(430): a, c, t, g, unknown or other
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattanagtactcctccgaggctcactttcggcggagggaccaaggtggagatcaaacgaactgtggc

SEQ ID NO: 569797 - DNA, 504 bp, Homo sapiens
  misc_feature: HIJSMM301C9E56.8.24.C02.1.454.light.4.raw
ctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 569798 - DNA, 507 bp, Homo sapiens
  misc_feature: HIJSMM301DK7DI.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtggaaatcaaacgaactgtggctgcaccatctgtctt

SEQ ID NO: 569799 - DNA, 462 bp, Homo sapiens
  misc_feature: HIJSMM301D1R49.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcctgggaccagagtggacatgaaacgaa

SEQ ID NO: 569800 - DNA, 486 bp, Homo sapiens
  misc_feature: HIJSMM301D143K.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 569801 - DNA, 444 bp, Homo sapiens; identical to SEQ ID NO: 535027
  misc_feature: HIJSMM301A7H5K.8.73.G07.1.454.light.4.raw

SEQ ID NO: 569802 - DNA, 479 bp, Homo sapiens
  misc_feature: HIJSMM301AW8UG.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcggcctccctggccatcactgggctccaggctgaggatgaggctgattattactgccagtcgtatgacagcagcctgagtgtttgggtgttcggcggagggacc

SEQ ID NO: 569803 - DNA, 480 bp, Homo sapiens
  misc_feature: HIJSMM301CDK32.51.76.G10.1.454.light.4.raw
cgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacca

SEQ ID NO: 569804 - DNA, 482 bp, Homo sapiens; identical to SEQ ID NO: 560945
  misc_feature: HIJSMM301APOHT.13.8.A08.1.454.light.4.raw

SEQ ID NO: 569805 - DNA, 521 bp, Homo sapiens; identical to SEQ ID NO: 539470
  misc_feature: HIJSMM301EORGZ.27.23.C01.1.454.light.4.raw

SEQ ID NO: 569806 - DNA, 491 bp, Homo sapiens
  misc_feature: HIJSMM301AYKH1.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctaggggaccaagctggagatcaaacgaactgtgg

SEQ ID NO: 569807 - DNA, 447 bp, Homo sapiens; identical to SEQ ID NO: 535020
  misc_feature: HIJSMM301AEEDC.18.9.A09.1.454.light.4.raw

SEQ ID NO: 569808 - DNA, 492 bp, Homo sapiens; identical to SEQ ID NO: 539815
  misc_feature: HIJSMM301B95HH.51.81.H04.1.454.light.4.raw

SEQ ID NO: 569809 - DNA, 444 bp, Homo sapiens; identical to SEQ ID NO: 535192
  misc_feature: HIJSMM301DAC8A.5.9.A09.1.454.light.4.raw

SEQ ID NO: 569810 - DNA, 503 bp, Homo sapiens; identical to SEQ ID NO: 554233
  misc_feature: HIJSMM301AKMYJ.4.39.D06.1.454.light.4.raw

SEQ ID NO: 569811 - DNA, 498 bp, Homo sapiens
  misc_feature: HIJSMM301BX543.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatccttcccgccatctgac

SEQ ID NO: 569812 - DNA, 497 bp, Homo sapiens; identical to SEQ ID NO: 536376
  misc_feature: HIJSMM301AHB9N.22.9.A09.1.454.light.4.raw

SEQ ID NO: 569813 - DNA, 511 bp, Homo sapiens; identical to SEQ ID NO: 548818
  misc_feature: HIJSMM301BNBGI.40.53.E09.1.454.light.4.raw

SEQ ID NO: 569814 - DNA, 502 bp, Homo sapiens
  misc_feature: HIJSMM301C7N3Z.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatcctgacatta

SEQ ID NO: 569815 - DNA, 506 bp, Homo sapiens
  misc_feature: HIJSMM301EXQ9O.21.22.B11.1.454.light.4.raw
  modified_base (101)..(101): a, c, t, g, unknown or other
tcgtcgctcgcacgaccggtgctcgatttagacgacagctcaggggagcttcagctgtggtagagaagacaggactcaggacaatctccagcatggccggnttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccgggtccgaggatgaggctgactattactgtgcatcacgggacgcaacatgggatggacaatctgagcggttgggtgttcgggcggagggaccaaactgaccgtcctaggtcagccccaa

SEQ ID NO: 569816 - DNA, 493 bp, Homo sapiens; identical to SEQ ID NO: 541037
  misc_feature: HIJSMM301CYIY5.53.22.B11.1.454.light.4.raw

SEQ ID NO: 569817 - DNA, 502 bp, Homo sapiens
  misc_feature: HIJSMM301BPZXX.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtctaagtcagcccaaggccaacccactgtcactctgttcccaccct

SEQ ID NO: 569818 - DNA, 496 bp, Homo sapiens; identical to SEQ ID NO: 535109
  misc_feature: HIJSMM301CZZJL.16.78.H01.1.454.light.4.raw

SEQ ID NO: 569819 - DNA, 513 bp, Homo sapiens
  misc_feature: HIJSMM301APZF0.5.58.F03.1.454.light.4.raw
atcagacacgcacgaccggtgctcgatttagtctgatcgagaagggaaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 569820 - DNA, 495 bp, Homo sapiens; identical to SEQ ID NO: 555261
  misc_feature: HIJSMM301CVZV5.51.71.G05.1.454.light.4.raw

SEQ ID NO: 569821 - DNA, 495 bp, Homo sapiens
  misc_feature: HIJSMM301AMGCM.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaacccatgcactctgttcccaccctctcgtatctctcg

SEQ ID NO: 569822 - DNA, 483 bp, Homo sapiens
  misc_feature: HIJSMM301BRNGG.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggagatcaaacgaactgtggctgcaccatct

SEQ ID NO: 569823 - DNA, 484 bp, Homo sapiens; identical to SEQ ID NO: 535400
  misc_feature: HIJSMM301DQZ7G.46.26.C04.1.454.light.4.raw

SEQ ID NO: 569824 - DNA, 481 bp, Homo sapiens
  misc_feature: HIJSMM301D0AB3.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcagctcatatacaaccatcaacacacaggtcttcggaagtgggaccaagtcaccgtcct

SEQ ID NO: 569825 - DNA, 491 bp, Homo sapiens; identical to SEQ ID NO: 536211
  misc_feature: HIJSMM301CE1I9.16.53.E09.1.454.light.4.raw

SEQ ID NO: 569826 - DNA, 521 bp, Homo sapiens; identical to SEQ ID NO: 539470
  misc_feature: HIJSMM301EI2A2.27.23.C01.1.454.light.4.raw

SEQ ID NO: 569827 - DNA, 493 bp, Homo sapiens; identical to SEQ ID NO: 535745
  misc_feature: HIJSMM301EQG3Q.47.78.H01.1.454.light.4.raw

SEQ ID NO: 569828 - DNA, 505 bp, Homo sapiens
  misc_feature: HIJSMM301DN202.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggtgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 569829 - DNA, 506 bp, Homo sapiens
  misc_feature: HIJSMM301C0TD7.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgatttattactgcagctcatatacaagcagcagcactcaagtcttcggaactgggaccaaggtcaccgtcctaggtcagcccaaggcccaacccactgtca

SEQ ID NO: 569830 - DNA, 506 bp, Homo sapiens
  misc_feature: HIJSMM301CEF9V.14.3.A03.1.454.light.4.raw
cgtctagtaccacgaccggtgctcgatttagagagcgtcacagggggggtcgtcaggaggcagcgctctcaggacatctccaccatggcctgggctctgctgttcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccggtcctaggtcagcccaaggctgccccctcggtcactctgtt

SEQ ID NO: 569831 - DNA, 492 bp, Homo sapiens; identical to SEQ ID NO: 540973
  misc_feature: HIJSMM301BLG75.43.20.B09.1.454.light.4.raw

SEQ ID NO: 569832 - DNA, 489 bp, Homo sapiens
  misc_feature: HIJSMM301EAAGM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcgtggagggaccaaggtggaggtcaaacgaactgtggctgcaccatctgtcttcat

SEQ ID NO: 569833 - DNA, 503 bp, Homo sapiens
  misc_feature: HIJSMM301DUNSH.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccgc

SEQ ID NO: 569834 - DNA, 394 bp, Homo sapiens
  misc_feature: HIJSMM301BBQH9.49.86.H09.1.454.light.4.raw
agtcgagagacacgaccggtgctcgatttagtgctatagacttggtttggggtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 569835 - DNA, 503 bp, Homo sapiens
  misc_feature: HIJSMM301B9JNE.43.14.B03.1.454.light.4.raw
tgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgactaggtcagcccaaggcccaaccccactgtca

SEQ ID NO: 569836 - DNA, 500 bp, Homo sapiens; identical to SEQ ID NO: 566764
  misc_feature: HIJSMM301CYL4F.48.67.G01.1.454.light.4.raw

SEQ ID NO: 569837 - DNA, 500 bp, Homo sapiens
  misc_feature: HIJSMM301AF92Y.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccta

SEQ ID NO: 569838 - DNA, 487 bp, Homo sapiens; identical to SEQ ID NO: 535863
  misc_feature: HIJSMM301EO8ET.19.71.G05.1.454.light.4.raw

SEQ ID NO: 569839 - DNA, 479 bp, Homo sapiens; identical to SEQ ID NO: 535118
  misc_feature: HIJSMM301AUYQQ.13.59.F04.1.454.light.4.raw

SEQ ID NO: 569840 - DNA, 502 bp, Homo sapiens
  misc_feature: HIJSMM301A65UM.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccgcctcct

SEQ ID NO: 569841 - DNA, 492 bp, Homo sapiens; identical to SEQ ID NO: 536010
  misc_feature: HIJSMM301B5XAA.10.20.B09.1.454.light.4.raw

SEQ ID NO: 569842 - DNA, 504 bp, Homo sapiens
  misc_feature: HIJSMM301CIZ75.40.42.D09.1.454.light.4.raw
tctagcgactcacgaccggtgctcgatttagacacatacgcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaactgtggctgcaccatctgtcttcatcttcccgcc

SEQ ID NO: 569843 - DNA, 514 bp, Homo sapiens; identical to SEQ ID NO: 550589
  misc_feature: HIJSMM301BBO87.16.66.F11.1.454.light.4.raw

SEQ ID NO: 569844 - DNA, 486 bp, Homo sapiens
  misc_feature: HIJSMM301EUM1P.5.41.D08.1.454.light.4.raw
atcagacacgcacgaccggtgctcgatttagtcacgcgagaaagggaaaggggctgatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggacccagagtggatatcaaacgaa

SEQ ID NO: 569845 - DNA, 484 bp, Homo sapiens
  misc_feature: HIJSMM301DY2DG.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgactagtggctgcaccatctgtcttcat

SEQ ID NO: 569846 - DNA, 494 bp, Homo sapiens; identical to SEQ ID NO: 539006
  misc_feature: HIJSMM301EQZV8.48.1.A01.1.454.light.4.raw

SEQ ID NO: 569847 - DNA, 503 bp, Homo sapiens
  misc_feature: HIJSMM301BEKWO.52.58.F03.1.454.light.4.raw
cgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacagacttcactctcaccatcagcggtcttcaacctgaggactttggaacttactactgtcagcagagtgataatacccctcagactttcgtccgtcggcgtacacgtggagtgttcaaacgaaactaacgtggtcgtcgtcgaccactacttcg

SEQ ID NO: 569848 - DNA, 499 bp, Homo sapiens; identical to SEQ ID NO: 547044
  misc_feature: HIJSMM301DW4D7.43.71.G05.1.454.light.4.raw

SEQ ID NO: 569849 - DNA, 519 bp, Homo sapiens
  misc_feature: HIJSMM301A41BQ.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacttgggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaacggccaaccccactgtcactctcg

SEQ ID NO: 569850 - DNA, 485 bp, Homo sapiens; identical to SEQ ID NO: 536576
  misc_feature: HIJSMM301BEJK2.46.35.D02.1.454.light.4.raw

SEQ ID NO: 569851 - DNA, 494 bp, Homo sapiens; identical to SEQ ID NO: 535276
  misc_feature: HIJSMM301DX7Z2.16.6.A06.1.454.light.4.raw

SEQ ID NO: 569852 - DNA, 485 bp, Homo sapiens
  misc_feature: HIJSMM301C6SMO.41.36.D03.1.454.light.4.raw
tctatactatcacgaccggtgctcgatttagctgcgtcacgatctctcttggggtctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcgacgggaccaaggctcgtaccccg

SEQ ID NO: 569853 - DNA, 501 bp, Homo sapiens
  misc_feature: HIJSMM301BLDEG.48.67.G01.1.454.light.4.raw
agtatacatacacgaccggtgctcgatttagagtatacatattgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 569854 - DNA, 485 bp, Homo sapiens
  misc_feature: HIJSMM301BNQ21.17.26.C04.1.454.light.4.raw
cgtagactagcacgaccggtgctcgatttagtctagcgactttgggtttggggagtctcagtcaggacacagcatggacatgagggtccccgctcagctcctggggcccctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggaggaccaaggtggagatcaaacgaactgtggctgcaccatctgt

SEQ ID NO: 569855 - DNA, 499 bp, Homo sapiens; identical to SEQ ID NO: 545202
  misc_feature: HIJSMM301B125W.12.26.C04.1.454.light.4.raw

SEQ ID NO: 569856 - DNA, 493 bp, Homo sapiens; identical to SEQ ID NO: 535084
  misc_feature: HIJSMM301A3FRH.47.64.F09.1.454.light.4.raw

SEQ ID NO: 569857 - DNA, 502 bp, Homo sapiens
  misc_feature: HIJSMM301BLZ3K.4.39.D06.1.454.light.4.raw
agcactgtagcacgaccggtgctcgatttagtgacatctcgcagttctttggggggggtctcaggaggcagcgctctcaggacgtcaccaccatggcctggactctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 569858 - DNA, 519 bp, Homo sapiens
  misc_feature: HIJSMM301DHG5R.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacggaccgaaggtaggaaggtacaaacgaaacctagtggctggcaccactctgtcttctatcttcccgtcccact

SEQ ID NO: 569859 - DNA, 479 bp, Homo sapiens
  misc_feature: HIJSMM301EU7Z1.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggcctcagggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 569860 - DNA, 481 bp, Homo sapiens
  misc_feature: HIJSMM301CVRU9.4.2.A02.1.454.light.4.raw
  modified_base (474)..(474): a, c, t, g, unknown or other
agcactgtagcacgaccggtgctcgatttagactcatctacagggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaatttggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgngctgcac

SEQ ID NO: 569861 - DNA, 495 bp, Homo sapiens; identical to SEQ ID NO: 549777
  misc_feature: HIJSMM301EG6X4.51.35.D02.1.454.light.4.raw

SEQ ID NO: 569862 - DNA, 454 bp, Homo sapiens; identical to SEQ ID NO: 534964
  misc_feature: HIJSMM301B1LGE.19.86.H09.1.454.light.4.raw

SEQ ID NO: 569863 - DNA, 516 bp, Homo sapiens
  misc_feature: HIJSMM301D583D.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttccaccctcct

SEQ ID NO: 569864 - DNA, 441 bp, Homo sapiens; identical to SEQ ID NO: 534971
  misc_feature: HIJSMM301DGGJM.11.3.A03.1.454.light.4.raw

SEQ ID NO: 569865 - DNA, 480 bp, Homo sapiens
  misc_feature: HIJSMM301BJHDE.51.76.G10.1.454.light.4.raw
cgatcgtatacacgaccggtgctcgatttagtcactcatacaggggagagctctggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaact

SEQ ID NO: 569866 - DNA, 501 bp, Homo sapiens; identical to SEQ ID NO: 537459
  misc_feature: HIJSMM301DGMNG.18.26.C04.1.454.light.4.raw

SEQ ID NO: 569867 - DNA, 481 bp, Homo sapiens
  misc_feature: HIJSMM301AIXUF.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggactcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 569868 - DNA, 489 bp, Homo sapiens
  misc_feature: HIJSMM301AFGDL.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgtcggtccacggacgaacggtaggacgtacaacgaac

SEQ ID NO: 569869 - DNA, 514 bp, Homo sapiens; identical to SEQ ID NO: 541418
  misc_feature: HIJSMM301C07WS.17.33.C11.1.454.light.4.raw

SEQ ID NO: 569870 - DNA, 509 bp, Homo sapiens
  misc_feature: HIJSMM301DLBLA.47.85.H08.1.454.light.4.raw
agctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgtt

SEQ ID NO: 569871 - DNA, 508 bp, Homo sapiens
  misc_feature: HIJSMM301AMIXQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaagggaccgaaggtggaaatacaaacgaactagtggctgcaccactctgtcttcatcttccccg

SEQ ID NO: 569872 - DNA, 520 bp, Homo sapiens; identical to SEQ ID NO: 539176
  misc_feature: HIJSMM301DTRZM.27.23.C01.1.454.light.4.raw

SEQ ID NO: 569873 - DNA, 491 bp, Homo sapiens; identical to SEQ ID NO: 535176
  misc_feature: HIJSMM301A9R8G.13.39.D06.1.454.light.4.raw

SEQ ID NO: 569874 - DNA, 489 bp, Homo sapiens
  misc_feature: HIJSMM301CRKZ6.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataaatccatttaatttcggcgagggaccaaggtgagatcaaacgaactgtggctgcaccatctgtcttcatcttcccgcc

SEQ ID NO: 569875 - DNA, 467 bp, Homo sapiens; identical to SEQ ID NO: 538403
  misc_feature: HIJSMM301AHE7Z.41.48.E04.1.454.light.4.raw

SEQ ID NO: 569876 - DNA, 494 bp, Homo sapiens
  misc_feature: HIJSMM301DT7VX.49.39.D06.1.454.light.4.raw
agtcgagagacacgaccggtgctcgatttagtgacatctcgcagttctttggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgggactaattatgtttcctggtaccagcacctcccaggaacagcccccaaacgcctcatctatgaagataataagcgaccctcagggattcctgaccgattctctggctccaagtctggcacgtcagccaccctggacatcaccggactccagactgggacgaggccgattattactgcggaacatgggatagcagcctgagtgttgtgattttcggcggagggaccaagctgaccgtcctac

SEQ ID NO: 569877 - DNA, 479 bp, Homo sapiens; identical to SEQ ID NO: 535118
  misc_feature: HIJSMM301CME5S.13.59.F04.1.454.light.4.raw

SEQ ID NO: 569878 - DNA, 506 bp, Homo sapiens
  misc_feature: HIJSMM301AQAWZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccgaaggtggaaagtacaaacgaactagtggctgcaccatctgtcttctatcttccccg

SEQ ID NO: 569879 - DNA, 480 bp, Homo sapiens
  misc_feature: HIJSMM301CWLG6.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagatttgcaatttattactgtcagcagtataataactggcctccgtacacttttggccaggggaccaagctggagatcaaacgaactgtggctgcacca

SEQ ID NO: 569880 - DNA, 514 bp, Homo sapiens
  misc_feature: HIJSMM301D6DD9.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcggtccacggggaccgaccacgtagaaagtagagacgaactagtggcgtgcaccatctgtcttctactcttcccgt

SEQ ID NO: 569881 - DNA, 509 bp, Homo sapiens
  misc_feature: HIJSMM301C7KCE.48.31.C09.1.454.light.4.raw
agtatacatacacgaccggtgctcgatttagacgtctcatcaaggaaggaagggggtcaggctggaactgaggagcaggtgggggcacttctccctctaacactctccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaaactgtggctgcaccatctgtcttcta

SEQ ID NO: 569882 - DNA, 552 bp, Homo sapiens
  misc_feature: HIJSMM301C1ORP.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccccctaccaacaacgcataagcgtcgctgccgcagcttcggtgcatggtttagccccgtttcatcttcccgccatctgactagtctacg

SEQ ID NO: 569883 - DNA, 510 bp, Homo sapiens; identical to SEQ ID NO: 562919
  misc_feature: HIJSMM301CMDG1.47.55.E11.1.454.light.4.raw

SEQ ID NO: 569884 - DNA, 507 bp, Homo sapiens; identical to SEQ ID NO: 561702
  misc_feature: HIJSMM301BKEPJ.5.24.C02.1.454.light.4.raw

SEQ ID NO: 569885 - DNA, 494 bp, Homo sapiens; identical to SEQ ID NO: 534994
  misc_feature: HIJSMM301A1NDL.27.78.H01.1.454.light.4.raw

SEQ ID NO: 569886 - DNA, 498 bp, Homo sapiens; identical to SEQ ID NO: 540839
  misc_feature: HIJSMM301AH6JS.48.38.D05.1.454.light.4.raw

SEQ ID NO: 569887 - DNA, 501 bp, Homo sapiens
  misc_feature: HIJSMM301CPHTQ.53.30.C08.1.454.light.4.raw
cgcgtatacacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcactctcg

SEQ ID NO: 569888 - DNA, 482 bp, Homo sapiens
  misc_feature: HIJSMM301ECKDX.5.39.D06.1.454.light.4.raw
atcagacacgcacgaccggtgctcgatttagtgacatctcgcagttctttgggggagtcagactcagtcaggacactgcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 569889 - DNA, 484 bp, Homo sapiens
  misc_feature: HIJSMM301EX0RJ.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaaaggtaggaaagtacaaacgaaactagtggctgcaa

SEQ ID NO: 569890 - DNA, 497 bp, Homo sapiens
  misc_feature: HIJSMM301CO0EE.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttccgcc

SEQ ID NO: 569891 - DNA, 513 bp, Homo sapiens
  misc_feature: HIJSMM301DHARW.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtttactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactc

SEQ ID NO: 569892 - DNA, 466 bp, Homo sapiens; identical to SEQ ID NO: 536398
  misc_feature: HIJSMM301AI8ZD.3.20.B09.1.454.light.4.raw

SEQ ID NO: 569893 - DNA, 444 bp, Homo sapiens; identical to SEQ ID NO: 535192
  misc_feature: HIJSMM301AE8LY.5.9.A09.1.454.light.4.raw

SEQ ID NO: 569894 - DNA, 497 bp, Homo sapiens; identical to SEQ ID NO: 535740
  misc_feature: HIJSMM301CKQYB.3.71.G05.1.454.light.4.raw

SEQ ID NO: 569895 - DNA, 520 bp, Homo sapiens
  misc_feature: HIJSMM301E4D2K.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaaggaccgaaggtaggaagtacgaaacgaaactacgtggcgtgcgaccactctgtcttctacttcttcccgtcctact

SEQ ID NO: 569896 - DNA, 491 bp, Homo sapiens; identical to SEQ ID NO: 538238
  misc_feature: HIJSMM301CZQ4Z.26.78.H01.1.454.light.4.raw

SEQ ID NO: 569897 - DNA, 491 bp, Homo sapiens; identical to SEQ ID NO: 535294
  misc_feature: HIJSMM301EP4CI.16.68.G02.1.454.light.4.raw

SEQ ID NO: 569898 - DNA, 482 bp, Homo sapiens; identical to SEQ ID NO: 535796
  misc_feature: HIJSMM301C011L.51.64.F09.1.454.light.4.raw

SEQ ID NO: 569899 - DNA, 443 bp, Homo sapiens
  misc_feature: HIJSMM301DR1WI.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccaggtcactctgttcccaccctcctcgacacgcgag

SEQ ID NO: 569900 - DNA, 500 bp, Homo sapiens
  misc_feature: HIJSMM301EGBT5.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtccctaagtcagccccaa

SEQ ID NO: 569901 - DNA, 514 bp, Homo sapiens
  misc_feature: HIJSMM301CY2OB.5.27.C05.1.454.light.4.raw
  modified_base (505)..(505): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactggaccaaggtcaccgtcctaggtcagcccaaggccaaccccactgtcactctgttcccnccctcctcc

SEQ ID NO: 569902 - DNA, 493 bp, Homo sapiens; identical to SEQ ID NO: 535661
  misc_feature: HIJSMM301DZSDY.22.29.C07.1.454.light.4.raw

SEQ ID NO: 569903 - DNA, 506 bp, Homo sapiens
  misc_feature: HIJSMM301CQVMB.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcggggtgttcggcggagggaccaagctgaccgtctaagtcagcccaaggctgccccctcggtcactctcg

SEQ ID NO: 569904 - DNA, 503 bp, Homo sapiens; identical to SEQ ID NO: 564479
  misc_feature: HIJSMM301ASZ5A.11.57.F02.1.454.light.4.raw

SEQ ID NO: 569905 - DNA, 496 bp, Homo sapiens
  misc_feature: HIJSMM301DLA03.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgca

SEQ ID NO: 569906 - DNA, 494 bp, Homo sapiens
  misc_feature: HIJSMM301AGCLW.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcggccaaggaccaaggtggacgatcaaacgaactagtggcgtgcaccactctcgtctt

SEQ ID NO: 569907 - DNA, 494 bp, Homo sapiens
  misc_feature: HIJSMM301C35PJ.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggtccg

SEQ ID NO: 569908 - DNA, 496 bp, Homo sapiens
  misc_feature: HIJSMM301COB07.49.62.F07.1.454.light.4.raw
agtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaggtcacgtcctggtcagcccaaggccaacccactgtcactctcg

SEQ ID NO: 569909 - DNA, 487 bp, Homo sapiens; identical to SEQ ID NO: 558003
  misc_feature: HIJSMM301BXCR3.47.70.G04.1.454.light.4.raw

SEQ ID NO: 569910 - DNA, 505 bp, Homo sapiens
  misc_feature: HIJSMM301CSXR5.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtcta

SEQ ID NO: 569911 - DNA, 448 bp, Homo sapiens; identical to SEQ ID NO: 538166
  misc_feature: HIJSMM301A5EV9.18.9.A09.1.454.light.4.raw

SEQ ID NO: 569912 - DNA, 485 bp, Homo sapiens
  misc_feature: HIJSMM301DVMRT.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactaatgatagttacccgctcactttcggcggagggaccaaggtggaggtcaagcgaactgtggctgcaccta

SEQ ID NO: 569913 - DNA, 519 bp, Homo sapiens
  misc_feature: HIJSMM301DV2K9.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggactattcggcggagggaccaagctgaccgtcctaggtcagcccaaggctgccccctcggtcactctgttcccaccctcctct

SEQ ID NO: 569914 - DNA, 489 bp, Homo sapiens; identical to SEQ ID NO: 542061
  misc_feature: HIJSMM301A0Z37.15.8.A08.1.454.light.4.raw

SEQ ID NO: 569915 - DNA, 499 bp, Homo sapiens
  misc_feature: HIJSMM301B8CUF.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacattggtgattataactatgtctcctggtaccagcagcacccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccca

SEQ ID NO: 569916 - DNA, 444 bp, Homo sapiens; identical to SEQ ID NO: 537637
  misc_feature: HIJSMM301BNUQI.8.11.A11.1.454.light.4.raw

SEQ ID NO: 569917 - DNA, 514 bp, Homo sapiens; identical to SEQ ID NO: 538541
  misc_feature: HIJSMM301BH7FO.47.23.C01.1.454.light.4.raw

SEQ ID NO: 569918 - DNA, 454 bp, Homo sapiens; identical to SEQ ID NO: 534964
  misc_feature: HIJSMM301DGI6B.19.86.H09.1.454.light.4.raw

SEQ ID NO: 569919 - DNA, 497 bp, Homo sapiens
  misc_feature: HIJSMM301AZA38.49.81.H04.1.454.light.4.raw
agtcgagagacacgaccggtgctcgatttagtagtgtagattcgcggggaagagctgctcagttaggacccagagggaaccatggaaaccccagcgcagcttctcttcctcctgctactctggctcccagataccaccggcgaagttgtgttgacgcagtctccaggcaccttgtctctgtctccaggggaaacagccaccctctcctgcagggccagtcagagtgttggcagctattatatagcctggtaccagcagaaacctggccaggctcccaggctcctcatctatggcggatccaacagggccactggcatcccagacaggttcagtggcagtgggtctgggccagacttcactctcacgatcaacagactggagcctgacgatatgggaatgtattactgcgagcagtttgggaactcaccatggacgttcggtccaggggaccgaaggtaggagatcaaacgaactgtggctgcaccatctgtcttcta

SEQ ID NO: 569920 - DNA, 483 bp, Homo sapiens
  misc_feature: HIJSMM301B3ZZX.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattatttgccaacagtataagagttattcaactttcggccctgggaccaatgtggatatcaaacgaactgtggctgcaccatctgtt

SEQ ID NO: 569921 - DNA, 500 bp, Homo sapiens
  misc_feature: HIJSMM301BGL0N.40.73.G07.1.454.light.4.raw
tctagcgactcacgaccggtgctcgatttagctctacgctcagggggaagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtatttttgtcaacaacatgataagtcaccgttcagctttggccgggggacccaggtggagatcagacgaactgtggctgcaccatctgtcttcatcttccccg

SEQ ID NO: 569922 - DNA, 495 bp, Homo sapiens
  misc_feature: HIJSMM301DPZXA.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaaactgtggctgcaccatctgtcttcat

SEQ ID NO: 569923 - DNA, 488 bp, Homo sapiens
  misc_feature: HIJSMM301BRGBG.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccagggaccgacggtcggagtgtcaagcgaactgtggctgcaccta

SEQ ID NO: 569924 - DNA, 486 bp, Homo sapiens; identical to SEQ ID NO: 535043
  misc_feature: HIJSMM301B1XPO.46.35.D02.1.454.light.4.raw

SEQ ID NO: 569925 - DNA, 478 bp, Homo sapiens
  misc_feature: HIJSMM301BCN8W.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatctcactctcactgtcagcagtctgcaatttgaagtattttgcaactttactactgtcaacagagtttcagttatcccttggactttcggaccaaggaccaaggtggaaaatccaaaacgaa

SEQ ID NO: 569926 - DNA, 501 bp, Homo sapiens
  misc_feature: HIJSMM301EY6NM.41.53.E09.1.454.light.4.raw
tctatactatcacgaccggtgctcgatttagagagagtgtgttggggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctccg

SEQ ID NO: 569927 - DNA, 493 bp, Homo sapiens
  misc_feature: HIJSMM301DICS5.4.9.A09.1.454.light.4.raw
agcactgtagcacgaccggtgctcgatttagcgagacgcgcagggggaggaactgctcagttaggacccagacggaaccatggaagccccagcgcagcttcttttcctcctgctactctggctcccagataccactggagaaatagtgatgacgcagtctccagccaccctgtctgtgtctccaggggcaagggccaccctctcctgcagggccagtcagagtgtcagcaacaacttagcctggtaccagcagaaacctggccagcctcccaggctcctcatctatggtacatccaccagggccactggtattccagtcaggtttagtggcagcgggtctgggacagaattcactctcaccatcagcagcctgcagtctgaagattttgcagtttattactgtcagcagtataataattggcctccttcacttttcggccctgggaccaaagtggatatacaaacgaactgtggctgcaccatctgtcttcta

SEQ ID NO: 569928 - DNA, 483 bp, Homo sapiens; identical to SEQ ID NO: 535413
  misc_feature: HIJSMM301BUOU6.26.78.H01.1.454.light.4.raw

SEQ ID NO: 569929 - DNA, 501 bp, Homo sapiens
  misc_feature: HIJSMM301C1CV9.18.78.H01.1.454.light.4.raw
  modified_base (496)..(496): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtctaggcagcccaaggccaacccntgtca

SEQ ID NO: 569930 - DNA, 512 bp, Homo sapiens
  misc_feature: HIJSMM301ANY2H.8.33.C11.1.454.light.4.raw
  modified_base (502)..(502): a, c, t, g, unknown or other
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtcgggaccgaaggtggaggatcaaacgaactgtggctgcaccanctgtcttcta

SEQ ID NO: 569931 - DNA, 494 bp, Homo sapiens; identical to SEQ ID NO: 535680
  misc_feature: HIJSMM301CD1HC.16.78.H01.1.454.light.4.raw

SEQ ID NO: 569932 - DNA, 354 bp, Homo sapiens; identical to SEQ ID NO: 535026
  misc_feature: HIJSMM301EPNO8.19.22.B11.1.454.light.4.raw

SEQ ID NO: 569933 - DNA, 485 bp, Homo sapiens; identical to SEQ ID NO: 536040
  misc_feature: HIJSMM301EBQ2J.15.1.A01.1.454.light.4.raw

SEQ ID NO: 569934 - DNA, 484 bp, Homo sapiens; identical to SEQ ID NO: 535287
  misc_feature: HIJSMM301CNVC9.13.56.F01.1.454.light.4.raw

SEQ ID NO: 569935 - DNA, 513 bp, Homo sapiens
  misc_feature: HIJSMM301C0C8T.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactcggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 569936 - DNA, 481 bp, Homo sapiens
  misc_feature: HIJSMM301D61XF.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacatctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 569937 - DNA, 503 bp, Homo sapiens; identical to SEQ ID NO: 537189
  misc_feature: HIJSMM301BK1CG.19.85.H08.1.454.light.4.raw

SEQ ID NO: 569938 - DNA, 473 bp, Homo sapiens
  misc_feature: HIJSMM301C8AK0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaagggtggacatcaaacgaa

SEQ ID NO: 569939 - DNA, 516 bp, Homo sapiens
  misc_feature: HIJSMM301CJT6F.17.31.C09.1.454.light.4.raw
cgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagaccccg

SEQ ID NO: 569940 - DNA, 495 bp, Homo sapiens
  misc_feature: HIJSMM301DU9Q7.43.16.B05.1.454.light.4.raw
tgtgagtagtcacgaccggtgctcgatttagagctcacgtaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactggggtcccatcaaggttcagtggcagtggatctggggcagatttcactctcaacatcggcagtgttcaacctgaagattttgcgacttattattgtcaacagagtcacagtttcccgtacacttttggccaggggaccaggctggagagcaaacgaactgtggctgcaccatctgtcttcatcttccccg

SEQ ID NO: 569941 - DNA, 508 bp, Homo sapiens
  misc_feature: HIJSMM301AG2QG.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtagggaaagtacaaacgaactagtggctgcaccatctgtcttcatcttcccgccta

SEQ ID NO: 569942 - DNA, 488 bp, Homo sapiens
  misc_feature: HIJSMM301DQLSK.51.38.D05.1.454.light.4.raw
cgatcgtatacacgaccggtgctcgatttagtatctgatagttgggtttggggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaaggacgaggctgattattactgcagctcatatacaatcaataacaattgggtgttcggcggagggaccaaactgaccgtcctaggtcagcccaaggctgccccctcggtcactctgttcccgccctcctctcgtagcact

SEQ ID NO: 569943 - DNA, 493 bp, Homo sapiens; identical to SEQ ID NO: 535745
  misc_feature: HIJSMM301EE0KD.47.78.H01.1.454.light.4.raw

SEQ ID NO: 569944 - DNA, 504 bp, Homo sapiens; identical to SEQ ID NO: 544677
  misc_feature: HIJSMM301BT0KM.7.71.G05.1.454.light.4.raw

SEQ ID NO: 569945 - DNA, 491 bp, Homo sapiens; identical to SEQ ID NO: 546499
  misc_feature: HIJSMM301AX7EE.48.35.D02.1.454.light.4.raw

SEQ ID NO: 569946 - DNA, 487 bp, Homo sapiens; identical to SEQ ID NO: 537220
  misc_feature: HIJSMM301ELSCJ.16.53.E09.1.454.light.4.raw

SEQ ID NO: 569947 - DNA, 500 bp, Homo sapiens
  misc_feature: HIJSMM301EPQKB.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcagtcttcggaactgggaccaggtcaccgtctaggtcagcccaaggccaacccactgtca

SEQ ID NO: 569948 - DNA, 494 bp, Homo sapiens; identical to SEQ ID NO: 534994
  misc_feature: HIJSMM301ADS4E.27.78.H01.1.454.light.4.raw

SEQ ID NO: 569949 - DNA, 502 bp, Homo sapiens; identical to SEQ ID NO: 541971
  misc_feature: HIJSMM301CV0ZP.4.39.D06.1.454.light.4.raw

SEQ ID NO: 569950 - DNA, 494 bp, Homo sapiens; identical to SEQ ID NO: 534992
  misc_feature: HIJSMM301BCAW5.9.1.A01.1.454.light.4.raw

SEQ ID NO: 569951 - DNA, 517 bp, Homo sapiens
  misc_feature: HIJSMM301AW67Q.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccaccctcctccacg

SEQ ID NO: 569952 - DNA, 488 bp, Homo sapiens; identical to SEQ ID NO: 536554
  misc_feature: HIJSMM301EFL4B.26.37.D04.1.454.light.4.raw

SEQ ID NO: 569953 - DNA, 445 bp, Homo sapiens; identical to SEQ ID NO: 555301
  misc_feature: HIJSMM301CSEFN.5.9.A09.1.454.light.4.raw

SEQ ID NO: 569954 - DNA, 493 bp, Homo sapiens; identical to SEQ ID NO: 537912
  misc_feature: HIJSMM301EMR07.13.46.E02.1.454.light.4.raw

SEQ ID NO: 569955 - DNA, 495 bp, Homo sapiens; identical to SEQ ID NO: 537415
  misc_feature: HIJSMM301B8ZFE.4.27.C05.1.454.light.4.raw

SEQ ID NO: 569956 - DNA, 509 bp, Homo sapiens; identical to SEQ ID NO: 544573
  misc_feature: HIJSMM301AV09H.10.88.H11.1.454.light.4.raw

SEQ ID NO: 569957 - DNA, 487 bp, Homo sapiens
  misc_feature: HIJSMM301BYPV6.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 569958 - DNA, 487 bp, Homo sapiens
  misc_feature: HIJSMM301EMT8N.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcctaagggaccaaggtggatatcagacgaa

SEQ ID NO: 569959 - DNA, 495 bp, Homo sapiens; identical to SEQ ID NO: 536020
  misc_feature: HIJSMM301ECVEU.41.38.D05.1.454.light.4.raw

SEQ ID NO: 569960 - DNA, 477 bp, Homo sapiens; identical to SEQ ID NO: 554966
  misc_feature: HIJSMM301EGSQ9.12.1.A01.1.454.light.4.raw

SEQ ID NO: 569961 - DNA, 504 bp, Homo sapiens
  misc_feature: HIJSMM301CVW7L.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagtggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcacatctgt

SEQ ID NO: 569962 - DNA, 465 bp, Homo sapiens; identical to SEQ ID NO: 561271
  misc_feature: HIJSMM301A4IBE.13.4.A04.1.454.light.4.raw

SEQ ID NO: 569963 - DNA, 494 bp, Homo sapiens; identical to SEQ ID NO: 534994
  misc_feature: HIJSMM301CGRYM.27.78.H01.1.454.light.4.raw

SEQ ID NO: 569964 - DNA, 495 bp, Homo sapiens; identical to SEQ ID NO: 538651
  misc_feature: HIJSMM301B3451.10.79.H02.1.454.light.4.raw

SEQ ID NO: 569965 - DNA, 504 bp, Homo sapiens
  misc_feature: HIJSMM301DJ75F.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccgcct

SEQ ID NO: 569966 - DNA, 487 bp, Homo sapiens; identical to SEQ ID NO: 540408
  misc_feature: HIJSMM301DQ5MU.41.33.C11.1.454.light.4.raw

SEQ ID NO: 569967 - DNA, 496 bp, Homo sapiens; identical to SEQ ID NO: 535109
  misc_feature: HIJSMM301BLLE5.16.78.H01.1.454.light.4.raw

SEQ ID NO: 569968 - DNA, 461 bp, Homo sapiens
  misc_feature: HIJSMM301BGCRL.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtgagatcaaacgaa

SEQ ID NO: 569969 - DNA, 442 bp, Homo sapiens; identical to SEQ ID NO: 557721
  misc_feature: HIJSMM301D0AO0.11.3.A03.1.454.light.4.raw

SEQ ID NO: 569970 - DNA, 474 bp, Homo sapiens; identical to SEQ ID NO: 561309
  misc_feature: HIJSMM301B5ZV2.5.12.B01.1.454.light.4.raw

SEQ ID NO: 569971 - DNA, 494 bp, Homo sapiens; identical to SEQ ID NO: 534994
  misc_feature: HIJSMM301BZPEE.27.78.H01.1.454.light.4.raw

SEQ ID NO: 569972 - DNA, 503 bp, Homo sapiens
  misc_feature: HIJSMM301CUXJJ.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccgccta

SEQ ID NO: 569973 - DNA, 494 bp, Homo sapiens; identical to SEQ ID NO: 539894
  misc_feature: HIJSMM301B1UAA.16.53.E09.1.454.light.4.raw

SEQ ID NO: 569974 - DNA, 505 bp, Homo sapiens
  misc_feature: HIJSMM301BCYSN.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgcccctcggtcact

SEQ ID NO: 569975 - DNA, 500 bp, Homo sapiens; identical to SEQ ID NO: 556015
  misc_feature: HIJSMM301CUQPC.21.38.D05.1.454.light.4.raw

SEQ ID NO: 569976 - DNA, 514 bp, Homo sapiens
  misc_feature: HIJSMM301BI2S0.10.38.D05.1.454.light.4.raw
catagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccacct

SEQ ID NO: 569977 - DNA, 461 bp, Homo sapiens
  misc_feature: HIJSMM301AMN51.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttacttcaccatcagcagactgcagcctgaagatattgcaacatattactgtcaacagtatgataatctcccgctcactttcggcggagggaccaaggtggagatcaaacgaa

SEQ ID NO: 569978 - DNA, 488 bp, Homo sapiens
  misc_feature: HIJSMM301BQGVO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcttacacttttgccagggaccaagctggagatcaaacgaactgt

SEQ ID NO: 569979 - DNA, 469 bp, Homo sapiens
  misc_feature: HIJSMM301EZM6W.48.80.H03.1.454.light.4.raw
agtatacatacacgaccggtgctcgatttagctgtgcgtcgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaag

SEQ ID NO: 569980 - DNA, 517 bp, Homo sapiens; identical to SEQ ID NO: 539798
  misc_feature: HIJSMM301DP97D.14.70.G04.1.454.light.4.raw

SEQ ID NO: 569981 - DNA, 495 bp, Homo sapiens; identical to SEQ ID NO: 542571
  misc_feature: HIJSMM301DKMHV.7.59.F04.1.454.light.4.raw

SEQ ID NO: 569982 - DNA, 507 bp, Homo sapiens; identical to SEQ ID NO: 563344
  misc_feature: HIJSMM301CJ5FP.3.79.H02.1.454.light.4.raw

SEQ ID NO: 569983 - DNA, 447 bp, Homo sapiens; identical to SEQ ID NO: 535020
  misc_feature: HIJSMM301C05EH.18.9.A09.1.454.light.4.raw

SEQ ID NO: 569984 - DNA, 508 bp, Homo sapiens; identical to SEQ ID NO: 552490
  misc_feature: HIJSMM301EK73X.17.41.D08.1.454.light.4.raw

SEQ ID NO: 569985 - DNA, 473 bp, Homo sapiens
  misc_feature: HIJSMM301BKOLU.52.27.C05.1.454.light.4.raw
cgcagtacgacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagccc

SEQ ID NO: 569986 - DNA, 501 bp, Homo sapiens
  misc_feature: HIJSMM301AWH6K.43.38.D05.1.454.light.4.raw
tgtgagtagtcacgaccggtgctcgatttagtatctgatagttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccca

SEQ ID NO: 569987 - DNA, 503 bp, Homo sapiens
  misc_feature: HIJSMM301AGW37.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacggttcggcggagggaccaaggtggagatcaaacgaactgtggctgcaccatctgtcttcattctttcccgccatctgacta

SEQ ID NO: 569988 - DNA, 488 bp, Homo sapiens
  misc_feature: HIJSMM301CFAFA.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccaagctggagatcacaggaactgtggctgcaccatt

SEQ ID NO: 569989 - DNA, 502 bp, Homo sapiens; identical to SEQ ID NO: 543936
  misc_feature: HIJSMM301D3WEU.15.1.A01.1.454.light.4.raw

SEQ ID NO: 569990 - DNA, 511 bp, Homo sapiens; identical to SEQ ID NO: 545985
  misc_feature: HIJSMM301BMKQD.7.34.D01.1.454.light.4.raw

SEQ ID NO: 569991 - DNA, 487 bp, Homo sapiens; identical to SEQ ID NO: 537573
  misc_feature: HIJSMM301D05RA.3.10.A10.1.454.light.4.raw

SEQ ID NO: 569992 - DNA, 488 bp, Homo sapiens; identical to SEQ ID NO: 556257
  misc_feature: HIJSMM301AH5BV.52.3.A03.1.454.light.4.raw

SEQ ID NO: 569993 - DNA, 506 bp, Homo sapiens
  misc_feature: HIJSMM301EN3GE.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccactttccggcctcgggaccaagtggatatacaaacgaactagtggctgcaccatctgtt

SEQ ID NO: 569994 - DNA, 499 bp, Homo sapiens
  misc_feature: HIJSMM301DK361.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggaggacccacctgaccgtctaggtcagcccaaggctgccccctcggtca

SEQ ID NO: 569995 - DNA, 486 bp, Homo sapiens; identical to SEQ ID NO: 542999
  misc_feature: HIJSMM301EHYX1.17.55.E11.1.454.light.4.raw

SEQ ID NO: 569996 - DNA, 493 bp, Homo sapiens; identical to SEQ ID NO: 535745
  misc_feature: HIJSMM301B31TO.47.78.H01.1.454.light.4.raw

SEQ ID NO: 569997 - DNA, 507 bp, Homo sapiens; identical to SEQ ID NO: 564521
  misc_feature: HIJSMM301DVBE8.21.87.H10.1.454.light.4.raw

SEQ ID NO: 569998 - DNA, 415 bp, Homo sapiens; identical to SEQ ID NO: 557542
  misc_feature: HIJSMM301C2QCH.16.46.E02.1.454.light.4.raw

SEQ ID NO: 569999 - DNA, 497 bp, Homo sapiens
  misc_feature: HIJSMM301E17X6.16.68.G02.1.454.light.4.raw
  modified_base (429)..(429): a, c, t, g, unknown or other
  modified_base (472)..(472): a, c, t, g, unknown or other
  modified_base (491)..(491): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaaattcactctcactatcaccagcctgcaacctgatgattttgcaacttattactgccaacagtaatcatcatcattntaatttcggttggagggaccaaggtggaggtacaaacgaaacngttggctgcaccatctgtnttcatt

SEQ ID NO: 570000 - DNA, 507 bp, Homo sapiens
  misc_feature: HIJSMM301DZZJI.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccgaaggtaggaatacaaacgaactagtggctgcaccatctgtcttcatcttcccgccat

SEQ ID NO: 570001 - DNA, 492 bp, Homo sapiens; identical to SEQ ID NO: 537666
  misc_feature: HIJSMM301DHU5A.43.33.C11.1.454.light.4.raw

SEQ ID NO: 570002 - DNA, 508 bp, Homo sapiens
  misc_feature: HIJSMM301EKH0Z.48.23.C01.1.454.light.4.raw
  modified_base (455)..(455): a, c, t, g, unknown or other
agtatacatacacgaccggtgctcgatttagtacacgtgattagggattgggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggngttcggcggagggaccaagttgaccgtcctaggtcaacccaggctgccccctc

SEQ ID NO: 570003 - DNA, 521 bp, Homo sapiens; identical to SEQ ID NO: 562813
  misc_feature: HIJSMM301BIE5B.10.86.H09.1.454.light.4.raw

SEQ ID NO: 570004 - DNA, 521 bp, Homo sapiens
  misc_feature: HIJSMM301BWL5D.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctggccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 570005 - DNA, 487 bp, Homo sapiens; identical to SEQ ID NO: 538190
  misc_feature: HIJSMM301DVTHL.47.70.G04.1.454.light.4.raw

SEQ ID NO: 570006 - DNA, 505 bp, Homo sapiens; identical to SEQ ID NO: 550885
  misc_feature: HIJSMM301AH0JE.18.78.H01.1.454.light.4.raw

SEQ ID NO: 570007 - DNA, 493 bp, Homo sapiens
  misc_feature: HIJSMM301ESOHW.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggaccagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggaccccaggctattgatgaggctgtctacttctgtcaggcgtgggacaacagcgtggtgttcggcggaggggaccagtctgaccgtcttaggtcagcccaaggctgccccctcggtcactc

SEQ ID NO: 570008 - DNA, 489 bp, Homo sapiens; identical to SEQ ID NO: 536663
  misc_feature: HIJSMM301B95XX.16.72.G06.1.454.light.4.raw

SEQ ID NO: 570009 - DNA, 509 bp, Homo sapiens; identical to SEQ ID NO: 547302
  misc_feature: HIJSMM301EQX2B.4.57.F02.1.454.light.4.raw

SEQ ID NO: 570010 - DNA, 514 bp, Homo sapiens
  misc_feature: HIJSMM301BYMQP.14.70.G04.1.454.light.4.raw
  modified_base (407)..(407): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgccaatggttncaccgcaaagcggggacccagaccctggagcctcagttggaagcagccgatccagcctgcggagcctgtgggcaggtcagcccaaggccaacccactgtcactctcg

SEQ ID NO: 570011 - DNA, 496 bp, Homo sapiens; identical to SEQ ID NO: 535109
  misc_feature: HIJSMM301DCG6A.16.78.H01.1.454.light.4.raw

SEQ ID NO: 570012 - DNA, 509 bp, Homo sapiens
  misc_feature: HIJSMM301C46JL.15.86.H09.1.454.light.4.raw
  modified_base (399)..(399): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaagacggttgggtgttcggcggagggaccaagcttgaccgtcctaggtcagcccaaggctgcccccctcggtcaactctgttccccgccctcctcga

SEQ ID NO: 570013 - DNA, 488 bp, Homo sapiens; identical to SEQ ID NO: 535081
  misc_feature: HIJSMM301D1FE2.26.23.C01.1.454.light.4.raw

SEQ ID NO: 570014 - DNA, 487 bp, Homo sapiens; identical to SEQ ID NO: 539157
  misc_feature: HIJSMM301D5645.26.37.D04.1.454.light.4.raw

SEQ ID NO: 570015 - DNA, 522 bp, Homo sapiens; identical to SEQ ID NO: 538091
  misc_feature: HIJSMM301AODCX.27.23.C01.1.454.light.4.raw

SEQ ID NO: 570016 - DNA, 499 bp, Homo sapiens
  misc_feature: HIJSMM301ANTN8.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattggtgttcggcggagggaccaagctgaccgtcctaagtcagcccaaggctgccccctcggtcactctgttccc

SEQ ID NO: 570017 - DNA, 503 bp, Homo sapiens
  misc_feature: HIJSMM301BVJE4.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggccctccctgaccatctctgggctccaggctggaggacgagggtgatttattactgcagctcatatagaagtggcagcactctcgtattcggcggtgggaccaagctcgaccgtcctaggtcacgcccaaggctcgccccctc

SEQ ID NO: 570018 - DNA, 497 bp, Homo sapiens
  misc_feature: HIJSMM301EX8LX.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaaggctgccccctcggtcactctgttcccaccctcctcc

SEQ ID NO: 570019 - DNA, 523 bp, Homo sapiens
  misc_feature: HIJSMM301BCM7S.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaagtacgaaacgaactagtggcgtgcgaccactactgtcttcctatcttcccgtccctact

SEQ ID NO: 570020 - DNA, 512 bp, Homo sapiens
  misc_feature: HIJSMM301ED2CO.48.27.C05.1.454.light.4.raw
agtatacatacacgaccggtgctcgatttagacgcgatcgaagggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggaggaccaagctgaccgtcctgggtcagcccaaggctgccccctcggtcactctgttcccacctcct

SEQ ID NO: 570021 - DNA, 504 bp, Homo sapiens; identical to SEQ ID NO: 535561
  misc_feature: HIJSMM301BZ9QX.4.57.F02.1.454.light.4.raw

SEQ ID NO: 570022 - DNA, 497 bp, Homo sapiens
  misc_feature: HIJSMM301C0SXU.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 570023 - DNA, 505 bp, Homo sapiens
  misc_feature: HIJSMM301E3X1U.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccgcctcctcg

SEQ ID NO: 570024 - DNA, 513 bp, Homo sapiens; identical to SEQ ID NO: 559106
  misc_feature: HIJSMM301EQJMB.11.57.F02.1.454.light.4.raw

SEQ ID NO: 570025 - DNA, 502 bp, Homo sapiens; identical to SEQ ID NO: 536253
  misc_feature: HIJSMM301APAGS.21.22.B11.1.454.light.4.raw

SEQ ID NO: 570026 - DNA, 375 bp, Homo sapiens; identical to SEQ ID NO: 544804
  misc_feature: HIJSMM301AJPWI.40.9.A09.1.454.light.4.raw

SEQ ID NO: 570027 - DNA, 489 bp, Homo sapiens; identical to SEQ ID NO: 535139
  misc_feature: HIJSMM301EWSGW.14.55.E11.1.454.light.4.raw

SEQ ID NO: 570028 - DNA, 489 bp, Homo sapiens; identical to SEQ ID NO: 536585
  misc_feature: HIJSMM301CKJZD.16.68.G02.1.454.light.4.raw

SEQ ID NO: 570029 - DNA, 509 bp, Homo sapiens
  misc_feature: HIJSMM301EL5QJ.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggtcgggaccaagctgaccgtcctaggtcagcccaaggctgccccctcggtcgta

SEQ ID NO: 570030 - DNA, 488 bp, Homo sapiens; identical to SEQ ID NO: 535081
  misc_feature: HIJSMM301CBEL0.26.23.C01.1.454.light.4.raw

SEQ ID NO: 570031 - DNA, 470 bp, Homo sapiens
  misc_feature: HIJSMM301CMFBL.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccgaaggtggagatggaagggaact

SEQ ID NO: 570032 - DNA, 492 bp, Homo sapiens
  misc_feature: HIJSMM301DJTVZ.17.53.E09.1.454.light.4.raw
cgtagactagcacgaccggtgctcgatttagagagagtgtgttgggtttgggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctgacaggttcagaggcagggggtctgggacagacttcactctcaccatcaacagactggagcctgaagattttgcaatttattattgtcagcagtatggttcctcaccatctttcggcggagggaccagggtggagatgaatcgaactgtggctgcaccatctgtcttcta

SEQ ID NO: 570033 - DNA, 486 bp, Homo sapiens; identical to SEQ ID NO: 535043
  misc_feature: HIJSMM301C0J42.46.35.D02.1.454.light.4.raw

SEQ ID NO: 570034 - DNA, 510 bp, Homo sapiens
  misc_feature: HIJSMM301DFYNT.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctgggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccact

SEQ ID NO: 570035 - DNA, 490 bp, Homo sapiens
  misc_feature: HIJSMM301C69OM.14.55.E11.1.454.light.4.raw
  modified_base (428)..(428): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtttacagtacccccctnactttcggcggagggaccaaggcggagatcagacgaactgtggctgcaccatctgtctttca

SEQ ID NO: 570036 - DNA, 486 bp, Homo sapiens
  misc_feature: HIJSMM301EQDJF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatacaaacgaactgtggctgcaccat

SEQ ID NO: 570037 - DNA, 486 bp, Homo sapiens; identical to SEQ ID NO: 535043
  misc_feature: HIJSMM301C5JJZ.46.35.D02.1.454.light.4.raw

SEQ ID NO: 570038 - DNA, 501 bp, Homo sapiens; identical to SEQ ID NO: 535746
  misc_feature: HIJSMM301DVMYA.18.11.A11.1.454.light.4.raw

SEQ ID NO: 570039 - DNA, 497 bp, Homo sapiens; identical to SEQ ID NO: 535286
  misc_feature: HIJSMM301AEM2V.18.59.F04.1.454.light.4.raw

SEQ ID NO: 570040 - DNA, 494 bp, Homo sapiens
  misc_feature: HIJSMM301EV3PE.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaaatcaacagagtggaggctgaggatgttggggtttattactgcatgcaagctctacaaaactccctcaacgttcggcggagggaccaaggtggagatcaaacgaactgtggctgcaccatctgtcttca

SEQ ID NO: 570041 - DNA, 447 bp, Homo sapiens; identical to SEQ ID NO: 535201
  misc_feature: HIJSMM301BRW0X.18.9.A09.1.454.light.4.raw

SEQ ID NO: 570042 - DNA, 472 bp, Homo sapiens
  misc_feature: HIJSMM301AW7E4.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggaggatcaagcgaactgt

SEQ ID NO: 570043 - DNA, 503 bp, Homo sapiens; identical to SEQ ID NO: 549080
  misc_feature: HIJSMM301B8X7S.53.49.E05.1.454.light.4.raw

SEQ ID NO: 570044 - DNA, 496 bp, Homo sapiens
  misc_feature: HIJSMM301CIX9M.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtcttgggacagacttcactctcaccatcagcagcctggagcctgaagatattgcagtttattactgtcagcagcgtagcaactggccttcactttcggcccgggacaagtggaaatcaaacgaactgtggctgcaccatctgtcttcatcttccgccat

SEQ ID NO: 570045 - DNA, 491 bp, Homo sapiens; identical to SEQ ID NO: 535294
  misc_feature: HIJSMM301ED8NX.16.68.G02.1.454.light.4.raw

SEQ ID NO: 570046 - DNA, 512 bp, Homo sapiens
  misc_feature: HIJSMM301C3BGJ.51.23.C01.1.454.light.4.raw
cgatcgtatacacgaccggtgctcgatttagtacacgtgattagggattggggagagccctggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttccccg

SEQ ID NO: 570047 - DNA, 505 bp, Homo sapiens
  misc_feature: HIJSMM301ECUSE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcgctgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgaccgtcctaaggtcagccccaa

SEQ ID NO: 570048 - DNA, 490 bp, Homo sapiens
  misc_feature: HIJSMM301C81LN.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 570049 - DNA, 485 bp, Homo sapiens
  misc_feature: HIJSMM301D3OKR.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagtcgggtggaggctgaggacgttggaatttattactgtatgcaaggtatagagcttcctccgacgttcggccaagggaccaaggtggaactcaaacgaactgtggctgcaccatctgtcttcatcttcccgccactctgactagtctacg

SEQ ID NO: 570050 - DNA, 418 bp, Homo sapiens
  misc_feature: HIJSMM301DSOUB.10.86.H09.1.454.light.4.raw
catagtagtgcacgaccggtgctcgatttagtgctatagacgttgggtttggggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccggtcctacgtcagcccaaggctgccccctcggtcactctgttcccaccctcctccactactatg

SEQ ID NO: 570051 - DNA, 488 bp, Homo sapiens
  misc_feature: HIJSMM301C395A.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctcggagatcaaacgaa

SEQ ID NO: 570052 - DNA, 493 bp, Homo sapiens; identical to SEQ ID NO: 537912
  misc_feature: HIJSMM301DHKTC.13.46.E02.1.454.light.4.raw

SEQ ID NO: 570053 - DNA, 454 bp, Homo sapiens; identical to SEQ ID NO: 534964
  misc_feature: HIJSMM301AG74J.19.86.H09.1.454.light.4.raw

SEQ ID NO: 570054 - DNA, 486 bp, Homo sapiens; identical to SEQ ID NO: 535043
  misc_feature: HIJSMM301DMM12.46.35.D02.1.454.light.4.raw

SEQ ID NO: 570055 - DNA, 485 bp, Homo sapiens; identical to SEQ ID NO: 541014
  misc_feature: HIJSMM301COMPS.7.85.H08.1.454.light.4.raw

SEQ ID NO: 570056 - DNA, 496 bp, Homo sapiens; identical to SEQ ID NO: 543244
  misc_feature: HIJSMM301ANREF.18.59.F04.1.454.light.4.raw

SEQ ID NO: 570057 - DNA, 503 bp, Homo sapiens; identical to SEQ ID NO: 537226
  misc_feature: HIJSMM301AEEZ0.19.85.H08.1.454.light.4.raw

SEQ ID NO: 570058 - DNA, 521 bp, Homo sapiens; identical to SEQ ID NO: 539470
  misc_feature: HIJSMM301DUQUC.27.23.C01.1.454.light.4.raw

SEQ ID NO: 570059 - DNA, 485 bp, Homo sapiens
  misc_feature: HIJSMM301DA3AE.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtgctgcaccatctgt

SEQ ID NO: 570060 - DNA, 491 bp, Homo sapiens
  misc_feature: HIJSMM301BHV8Y.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcagcgtagcaactggcctctcactttcggcggagggaccagggtggagatcagacgaactgtggctgcacc

SEQ ID NO: 570061 - DNA, 499 bp, Homo sapiens; identical to SEQ ID NO: 538774
  misc_feature: HIJSMM301CE1CL.26.26.C04.1.454.light.4.raw

SEQ ID NO: 570062 - DNA, 488 bp, Homo sapiens; identical to SEQ ID NO: 535081
  misc_feature: HIJSMM301DTTMQ.26.23.C01.1.454.light.4.raw

SEQ ID NO: 570063 - DNA, 495 bp, Homo sapiens
  misc_feature: HIJSMM301AP9M4.5.34.D01.1.454.light.4.raw
atcagacacgcacgaccggtgctcgatttagatcgtctgtgttggggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgttcaacaggctaacagtttaccctccgaccttcgtccgaacggacgacgactacggaggagtaacgtaactaacgtaggtcgt

SEQ ID NO: 570064 - DNA, 505 bp, Homo sapiens; identical to SEQ ID NO: 535503
  misc_feature: HIJSMM301B1HGN.8.28.C06.1.454.light.4.raw

SEQ ID NO: 570065 - DNA, 502 bp, Homo sapiens
  misc_feature: HIJSMM301EIFTP.48.27.C05.1.454.light.4.raw
agtatacatacacgaccggtgctcgatttagacgcgatcgaagggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 570066 - DNA, 504 bp, Homo sapiens
  misc_feature: HIJSMM301EK8TB.52.37.D04.1.454.light.4.raw
cgcagtacgacacgaccggtgctcgatttagtagcatactgttgggtttgggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 570067 - DNA, 501 bp, Homo sapiens
  misc_feature: HIJSMM301CLIKX.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctccggtcactcttcg

SEQ ID NO: 570068 - DNA, 482 bp, Homo sapiens
  misc_feature: HIJSMM301DYVVJ.52.22.B11.1.454.light.4.raw
cgcagtacgacacgaccggtgctcgatttagacgacagctcaggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtgggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatt

SEQ ID NO: 570069 - DNA, 508 bp, Homo sapiens
  misc_feature: HIJSMM301EQ3JV.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccgaaaattagagatcaaacgaaactgtggctgcaccatctgtcttcatcttcccgcca

SEQ ID NO: 570070 - DNA, 497 bp, Homo sapiens; identical to SEQ ID NO: 535764
  misc_feature: HIJSMM301BDG6Y.22.20.B09.1.454.light.4.raw

SEQ ID NO: 570071 - DNA, 494 bp, Homo sapiens; identical to SEQ ID NO: 534992
  misc_feature: HIJSMM301B8Q7J.9.1.A01.1.454.light.4.raw

SEQ ID NO: 570072 - DNA, 496 bp, Homo sapiens
  misc_feature: HIJSMM301AF9B2.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggaggatcaaacgaactagtggctgcaccatctgtt

SEQ ID NO: 570073 - DNA, 489 bp, Homo sapiens; identical to SEQ ID NO: 568239
  misc_feature: HIJSMM301CXNQQ.11.28.C06.1.454.light.4.raw

SEQ ID NO: 570074 - DNA, 493 bp, Homo sapiens; identical to SEQ ID NO: 543205
  misc_feature: HIJSMM301B28S3.51.6.A06.1.454.light.4.raw

SEQ ID NO: 570075 - DNA, 485 bp, Homo sapiens; identical to SEQ ID NO: 536723
  misc_feature: HIJSMM301BSFU9.5.40.D07.1.454.light.4.raw

SEQ ID NO: 570076 - DNA, 517 bp, Homo sapiens; identical to SEQ ID NO: 541955
  misc_feature: HIJSMM301AJV5O.22.30.C08.1.454.light.4.raw

SEQ ID NO: 570077 - DNA, 518 bp, Homo sapiens
  misc_feature: HIJSMM301B2EIQ.43.59.F04.1.454.light.4.raw
tgtgagtagtcacgaccggtgctcgatttagtacacacacttagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 570078 - DNA, 484 bp, Homo sapiens; identical to SEQ ID NO: 535441
  misc_feature: HIJSMM301ADP3V.26.60.F05.1.454.light.4.raw

SEQ ID NO: 570079 - DNA, 505 bp, Homo sapiens
  misc_feature: HIJSMM301EH0JE.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgcctccctctacgtcgtat

SEQ ID NO: 570080 - DNA, 447 bp, Homo sapiens; identical to SEQ ID NO: 535201
  misc_feature: HIJSMM301CYTIY.18.9.A09.1.454.light.4.raw

SEQ ID NO: 570081 - DNA, 495 bp, Homo sapiens; identical to SEQ ID NO: 537716
  misc_feature: HIJSMM301CG113.22.14.B03.1.454.light.4.raw

SEQ ID NO: 570082 - DNA, 496 bp, Homo sapiens; identical to SEQ ID NO: 536248
  misc_feature: HIJSMM301C5YFQ.22.27.C05.1.454.light.4.raw

SEQ ID NO: 570083 - DNA, 463 bp, Homo sapiens; identical to SEQ ID NO: 535008
  misc_feature: HIJSMM301BOPL8.10.9.A09.1.454.light.4.raw

SEQ ID NO: 570084 - DNA, 500 bp, Homo sapiens
  misc_feature: HIJSMM301DQW4A.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtactttttagttacgtcggaccttcggccaagggacacgactggagattaaacgaactgtggctgcaccatctgtctcatcttcccg

SEQ ID NO: 570085 - DNA, 495 bp, Homo sapiens; identical to SEQ ID NO: 538651
  misc_feature: HIJSMM301CVF3V.10.79.H02.1.454.light.4.raw

SEQ ID NO: 570086 - DNA, 502 bp, Homo sapiens
  misc_feature: HIJSMM301C67M8.22.26.C04.1.454.light.4.raw
acatacgcgtcacgaccggtgctcgatttagtctagcgactttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatcttccccg

SEQ ID NO: 570087 - DNA, 486 bp, Homo sapiens; identical to SEQ ID NO: 535043
  misc_feature: HIJSMM301ECCXZ.46.35.D02.1.454.light.4.raw

SEQ ID NO: 570088 - DNA, 508 bp, Homo sapiens
  misc_feature: HIJSMM301CZYHR.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtctaagtcagcccaaggctgccccctcggtcactctgttcccaccctcc

SEQ ID NO: 570089 - DNA, 486 bp, Homo sapiens
  misc_feature: HIJSMM301B344X.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccaggtctgaccgtcttaggtcagccc

SEQ ID NO: 570090 - DNA, 469 bp, Homo sapiens
  misc_feature: HIJSMM301B81AT.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctcaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 570091 - DNA, 454 bp, Homo sapiens; identical to SEQ ID NO: 534964
  misc_feature: HIJSMM301D6FIO.19.86.H09.1.454.light.4.raw

SEQ ID NO: 570092 - DNA, 514 bp, Homo sapiens
  misc_feature: HIJSMM301AXSJS.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccct

SEQ ID NO: 570093 - DNA, 500 bp, Homo sapiens
  misc_feature: HIJSMM301AXIUV.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagaccccg

SEQ ID NO: 570094 - DNA, 491 bp, Homo sapiens
  misc_feature: HIJSMM301CZ25D.52.35.D02.1.454.light.4.raw
cgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattattgtcagcactatggtaggtcacagtacacttttggtccgaggggaccgaagactggagatcaaacgaaactgtggctgcacca

SEQ ID NO: 570095 - DNA, 444 bp, Homo sapiens; identical to SEQ ID NO: 535192
  misc_feature: HIJSMM301C26NM.5.9.A09.1.454.light.4.raw

SEQ ID NO: 570096 - DNA, 485 bp, Homo sapiens
  misc_feature: HIJSMM301BZP7D.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccaggggaccaagctggagatcaaacgaactgtggctgcaccat

SEQ ID NO: 570097 - DNA, 490 bp, Homo sapiens
  misc_feature: HIJSMM301EYVHF.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatactaccactcactttcggtcggagggaccgacggtggaggatcaaacgaaactgtggctgcaccatctgtcttcta

SEQ ID NO: 570098 - DNA, 482 bp, Homo sapiens
  misc_feature: HIJSMM301BZOPJ.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctgacacagatttcactctcaccatcagcagcctgcagcctgaagattttgcaacttattactgtctacaagattacaattaccctcgaacgttcggccaagggaccaaggtggaagtcaaacgaactagtggctgcaccat

SEQ ID NO: 570099 - DNA, 504 bp, Homo sapiens
  misc_feature: HIJSMM301DIW2W.12.53.E09.1.454.light.4.raw
atacgacgtacacgaccggtgctcgatttagagagagtgtgttgggtttgggggctttgcctgggctctgctgctcctcactctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgacaatctctggctccaggctgaggacgaggcggattattactgttgctcatatgcgggtagtagcactttcgatgtcctattcggcggagggaccaagctgaccgtcctgggtcagcccaaggctgccccctggtcactctcgttcccaccctcctctacgtcgtat

SEQ ID NO: 570100 - DNA, 496 bp, Homo sapiens; identical to SEQ ID NO: 535541
  misc_feature: HIJSMM301ESOR0.3.33.C11.1.454.light.4.raw

SEQ ID NO: 570101 - DNA, 493 bp, Homo sapiens; identical to SEQ ID NO: 542565
  misc_feature: HIJSMM301ATZZI.48.71.G05.1.454.light.4.raw

SEQ ID NO: 570102 - DNA, 498 bp, Homo sapiens
  misc_feature: HIJSMM301AGCK9.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgccccctcggtcactctcg

SEQ ID NO: 570103 - DNA, 474 bp, Homo sapiens
  misc_feature: HIJSMM301EV3PW.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatacaaacgaa

SEQ ID NO: 570104 - DNA, 477 bp, Homo sapiens; identical to SEQ ID NO: 537678
  misc_feature: HIJSMM301CQWDV.12.1.A01.1.454.light.4.raw

SEQ ID NO: 570105 - DNA, 508 bp, Homo sapiens
  misc_feature: HIJSMM301BEHYZ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatggggatgacaatctgagcgggttgggtgttcggcggagggaccaaactgacccgtcctagggtcagccccaa

SEQ ID NO: 570106 - DNA, 489 bp, Homo sapiens
  misc_feature: HIJSMM301C4DND.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttccgcc

SEQ ID NO: 570107 - DNA, 486 bp, Homo sapiens; identical to SEQ ID NO: 535043
  misc_feature: HIJSMM301AI822.46.35.D02.1.454.light.4.raw

SEQ ID NO: 570108 - DNA, 487 bp, Homo sapiens; identical to SEQ ID NO: 535863
  misc_feature: HIJSMM301C4EE9.19.71.G05.1.454.light.4.raw

SEQ ID NO: 570109 - DNA, 503 bp, Homo sapiens; identical to SEQ ID NO: 555460
  misc_feature: HIJSMM301AXFGU.8.42.D09.1.454.light.4.raw

SEQ ID NO: 570110 - DNA, 483 bp, Homo sapiens; identical to SEQ ID NO: 545669
  misc_feature: HIJSMM301AFP0F.13.8.A08.1.454.light.4.raw

SEQ ID NO: 570111 - DNA, 491 bp, Homo sapiens
  misc_feature: HIJSMM301AQKXU.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacacgtctggccgttcacttttggccaggggaccaaactggatatcagacgaactgtggctgca

SEQ ID NO: 570112 - DNA, 499 bp, Homo sapiens; identical to SEQ ID NO: 535899
  misc_feature: HIJSMM301EPCCW.19.78.H01.1.454.light.4.raw

SEQ ID NO: 570113 - DNA, 493 bp, Homo sapiens
  misc_feature: HIJSMM301EMHU9.43.77.G11.1.454.light.4.raw
tgtgagtagtcacgaccggtgctcgatttagctagtcactcaagggaaagggggcttcagctgtgggcacaagaggcagcactcaggacagtctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcacg

SEQ ID NO: 570114 - DNA, 479 bp, Homo sapiens; identical to SEQ ID NO: 535118
  misc_feature: HIJSMM301DDUI3.13.59.F04.1.454.light.4.raw

SEQ ID NO: 570115 - DNA, 507 bp, Homo sapiens
  misc_feature: HIJSMM301CHNRN.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctcgcccccg

SEQ ID NO: 570116 - DNA, 525 bp, Homo sapiens
  misc_feature: HIJSMM301CMKG7.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctacttgtggtgctgtgctattcggtcggagggaccgaagactgaccgtccttaagttacagcccaacggacgtcgccccctcccggtccactcctaagttcccta

SEQ ID NO: 570117 - DNA, 496 bp, Homo sapiens; identical to SEQ ID NO: 537513
  misc_feature: HIJSMM301B20B3.12.87.H10.1.454.light.4.raw

SEQ ID NO: 570118 - DNA, 508 bp, Homo sapiens
  misc_feature: HIJSMM301B5JZ2.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccatggttgcaccgcaaagcggggacccagaccctggagcctcagttggaagcagccgatccagcctgcggagcctgtgggcaggtcagcccaaggccaaccccactgtcactc

SEQ ID NO: 570119 - DNA, 478 bp, Homo sapiens
  misc_feature: HIJSMM301AWC52.48.22.B11.1.454.light.4.raw
agtatacatacacgaccggtgctcgatttagacgacagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctcggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagcccaaggct

SEQ ID NO: 570120 - DNA, 475 bp, Homo sapiens
  misc_feature: HIJSMM301BC3XV.51.35.D02.1.454.light.4.raw
cgatcgtatacacgaccggtgctcgatttagcacacgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 570121 - DNA, 447 bp, Homo sapiens; identical to SEQ ID NO: 535020
  misc_feature: HIJSMM301ERCSH.18.9.A09.1.454.light.4.raw

SEQ ID NO: 570122 - DNA, 497 bp, Homo sapiens; identical to SEQ ID NO: 535740
  misc_feature: HIJSMM301CVU10.3.71.G05.1.454.light.4.raw

SEQ ID NO: 570123 - DNA, 497 bp, Homo sapiens
  misc_feature: HIJSMM301B1X5A.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcgccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 570124 - DNA, 494 bp, Homo sapiens; identical to SEQ ID NO: 534994
  misc_feature: HIJSMM301C98P8.27.78.H01.1.454.light.4.raw

SEQ ID NO: 570125 - DNA, 505 bp, Homo sapiens; identical to SEQ ID NO: 535503
  misc_feature: HIJSMM301AQANL.8.28.C06.1.454.light.4.raw

SEQ ID NO: 570126 - DNA, 486 bp, Homo sapiens; identical to SEQ ID NO: 537127
  misc_feature: HIJSMM301BQYYZ.3.77.G11.1.454.light.4.raw

SEQ ID NO: 570127 - DNA, 503 bp, Homo sapiens
  misc_feature: HIJSMM301C5HMC.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtgagatcaaacgaactgtggctgcaccatctgtcttcatcttcccgccat

SEQ ID NO: 570128 - DNA, 478 bp, Homo sapiens; identical to SEQ ID NO: 535129
  misc_feature: HIJSMM301BX7CP.11.11.A11.1.454.light.4.raw

SEQ ID NO: 570129 - DNA, 487 bp, Homo sapiens; identical to SEQ ID NO: 540841
  misc_feature: HIJSMM301BP4O1.4.33.C11.1.454.light.4.raw

SEQ ID NO: 570130 - DNA, 488 bp, Homo sapiens
  misc_feature: HIJSMM301AL9EL.48.37.D04.1.454.light.4.raw
agtatacatacacgaccggtgctcgatttagtagcatactgttgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 570131 - DNA, 484 bp, Homo sapiens
  misc_feature: HIJSMM301B3MS0.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtatacgaacgaactgtggctgcacc

SEQ ID NO: 570132 - DNA, 497 bp, Homo sapiens
  misc_feature: HIJSMM301B8447.4.3.A03.1.454.light.4.raw
agcactgtagcacgaccggtgctcgatttagagagcgtcacagggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagagccaccctctcctgccgggccagtgagagtcttagcggcgactacttagcctggtaccagcaaaacctggccagtctcccaggctcctcatctctggtgtatccttcagggccactggcatcccagacagattcaggggcagtgggtctgggacagacttcactctcaccatcagcagactggagcctgaagactttgcgctgtatttctgtcagcagtatgttttcgcaccttttcactttcggtcggagggaccaaggtggagaacaaacgaaactgtggctgcaccatctgtcttcatt

SEQ ID NO: 570133 - DNA, 502 bp, Homo sapiens; identical to SEQ ID NO: 541971
  misc_feature: HIJSMM301CAAC6.4.39.D06.1.454.light.4.raw

SEQ ID NO: 570134 - DNA, 504 bp, Homo sapiens; identical to SEQ ID NO: 544677
  misc_feature: HIJSMM301BZN8O.7.71.G05.1.454.light.4.raw

SEQ ID NO: 570135 - DNA, 486 bp, Homo sapiens
  misc_feature: HIJSMM301EO8YD.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaggggaccaaactggacatcaaacgaactgtggctgcaccatctgt

SEQ ID NO: 570136 - DNA, 512 bp, Homo sapiens
  misc_feature: HIJSMM301ANHOR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaaccaaggtaggaaatacaaacgaactacgtggcgtgcaccactctgtcttcatcttccccg

SEQ ID NO: 570137 - DNA, 461 bp, Homo sapiens
  misc_feature: HIJSMM301BV8CD.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctccgtatctctcg

SEQ ID NO: 570138 - DNA, 487 bp, Homo sapiens
  misc_feature: HIJSMM301C4XJB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaagtggataagtcagacgaa

SEQ ID NO: 570139 - DNA, 486 bp, Homo sapiens; identical to SEQ ID NO: 535458
  misc_feature: HIJSMM301AMSID.7.75.G09.1.454.light.4.raw

SEQ ID NO: 570140 - DNA, 493 bp, Homo sapiens; identical to SEQ ID NO: 537422
  misc_feature: HIJSMM301BELBL.9.34.D01.1.454.light.4.raw

SEQ ID NO: 570141 - DNA, 454 bp, Homo sapiens; identical to SEQ ID NO: 535005
  misc_feature: HIJSMM301AZ2D9.19.86.H09.1.454.light.4.raw

SEQ ID NO: 570142 - DNA, 498 bp, Homo sapiens
  misc_feature: HIJSMM301DYI3Q.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtctgggtcagcccaaggctgccccctcggtcactctgttcccacctcctctgtcgagcgt

SEQ ID NO: 570143 - DNA, 507 bp, Homo sapiens
  misc_feature: HIJSMM301CRKQ4.48.23.C01.1.454.light.4.raw
agtatacatacacgaccggtgctcgatttagtacacgtgattagggattgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacgagcaacaactgcgattttcgcggggggaccgaggctgacgtcggcggtcgagcccaaggctgccccctccggtcactctgttccaccctcct

SEQ ID NO: 570144 - DNA, 537 bp, Homo sapiens
  misc_feature: HIJSMM301A2MJT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggggcgtgtaggagtgttgggtcggtccttattaattagttcgatgtcgaagactctacctaagtacccgtccgtcctactttccggttccgggacggggaaccggaacggtagggtaggatacgtaaaccgaaaacgtaacgtt

SEQ ID NO: 570145 - DNA, 496 bp, Homo sapiens; identical to SEQ ID NO: 540594
  misc_feature: HIJSMM301A3Z52.4.59.F04.1.454.light.4.raw

SEQ ID NO: 570146 - DNA, 499 bp, Homo sapiens
  misc_feature: HIJSMM301AI0RC.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagccaaggctgccccctcggtcactctgttcccta

SEQ ID NO: 570147 - DNA, 476 bp, Homo sapiens; identical to SEQ ID NO: 537368
  misc_feature: HIJSMM301AVVEO.7.83.H06.1.454.light.4.raw

SEQ ID NO: 570148 - DNA, 520 bp, Homo sapiens
  misc_feature: HIJSMM301A2YIM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgaaacgaactagtggcgtgcaccactctgtcttctactcttccgtcccact

SEQ ID NO: 570149 - DNA, 519 bp, Homo sapiens
  misc_feature: HIJSMM301C7EOL.41.19.B08.1.454.light.4.raw
tctatactatcacgaccggtgctcgatttagtgagtcagtaagggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccgacgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctcat

SEQ ID NO: 570150 - DNA, 484 bp, Homo sapiens
  misc_feature: HIJSMM301EMYTO.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccgaagggaccaaggtggaaatacaaacgaactagtggctgcaccta

SEQ ID NO: 570151 - DNA, 467 bp, Homo sapiens
  misc_feature: HIJSMM301AHAJP.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgactcaccttcggccaaggacgacgactggagattaaacgaa

SEQ ID NO: 570152 - DNA, 498 bp, Homo sapiens
  misc_feature: HIJSMM301D343W.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtcactctcg

SEQ ID NO: 570153 - DNA, 494 bp, Homo sapiens
  misc_feature: HIJSMM301CAV96.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccgaagggaccaaggtaggaaagtacaaacgaactagtggctgca

SEQ ID NO: 570154 - DNA, 454 bp, Homo sapiens; identical to SEQ ID NO: 535005
  misc_feature: HIJSMM301CVAEM.19.86.H09.1.454.light.4.raw

SEQ ID NO: 570155 - DNA, 504 bp, Homo sapiens; identical to SEQ ID NO: 555291
  misc_feature: HIJSMM301EFY88.51.10.A10.1.454.light.4.raw

SEQ ID NO: 570156 - DNA, 495 bp, Homo sapiens
  misc_feature: HIJSMM301C4EWF.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactaggagattaaacgaactgtggctgcaccatctgtt

SEQ ID NO: 570157 - DNA, 478 bp, Homo sapiens; identical to SEQ ID NO: 541670
  misc_feature: HIJSMM301A0F68.13.73.G07.1.454.light.4.raw

SEQ ID NO: 570158 - DNA, 493 bp, Homo sapiens; identical to SEQ ID NO: 537281
  misc_feature: HIJSMM301CUIE0.9.1.A01.1.454.light.4.raw

SEQ ID NO: 570159 - DNA, 487 bp, Homo sapiens; identical to SEQ ID NO: 541444
  misc_feature: HIJSMM301D9XE9.19.71.G05.1.454.light.4.raw

SEQ ID NO: 570160 - DNA, 496 bp, Homo sapiens; identical to SEQ ID NO: 536690
  misc_feature: HIJSMM301BETV1.40.23.C01.1.454.light.4.raw

SEQ ID NO: 570161 - DNA, 490 bp, Homo sapiens; identical to SEQ ID NO: 541407
  misc_feature: HIJSMM301AEWJ0.14.55.E11.1.454.light.4.raw

SEQ ID NO: 570162 - DNA, 517 bp, Homo sapiens
  misc_feature: HIJSMM301D7EK4.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggctaggcccctgtactggtcatctttagcgattccaaccggccctctgggatccctgagcgattctctggctccaagtcggggaacacggccaccctgaccatcagcagggcccaacccttggatgagggtgactattctgtcaagtgtgggacaccaacacttgtgtcttcgggactgggaccgaggtcaccgtcctaagtcagcccagggccaaccccactgtcactctgttcccaccctcctcgacacg

SEQ ID NO: 570163 - DNA, 486 bp, Homo sapiens; identical to SEQ ID NO: 538568
  misc_feature: HIJSMM301EJE4D.47.38.D05.1.454.light.4.raw

SEQ ID NO: 570164 - DNA, 506 bp, Homo sapiens; identical to SEQ ID NO: 539434
  misc_feature: HIJSMM301AMRAJ.48.71.G05.1.454.light.4.raw

SEQ ID NO: 570165 - DNA, 507 bp, Homo sapiens
  misc_feature: HIJSMM301BZHZD.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagccaaggctgccccctcggtcactctcg

SEQ ID NO: 570166 - DNA, 509 bp, Homo sapiens
  misc_feature: HIJSMM301ET56T.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccac

SEQ ID NO: 570167 - DNA, 483 bp, Homo sapiens
  misc_feature: HIJSMM301CGBWI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggcagggaccaagctggagatcaacgaactgtggctgcaccat

SEQ ID NO: 570168 - DNA, 497 bp, Homo sapiens
  misc_feature: HIJSMM301AU9X6.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaaactgtggctgcaccatctgtcttctatt

SEQ ID NO: 570169 - DNA, 482 bp, Homo sapiens; identical to SEQ ID NO: 540521
  misc_feature: HIJSMM301B5JDU.21.25.C03.1.454.light.4.raw

SEQ ID NO: 570170 - DNA, 477 bp, Homo sapiens
  misc_feature: HIJSMM301EUHXB.52.40.D07.1.454.light.4.raw
cgcagtacgacacgaccggtgctcgatttagtgatagagcgtaacaacagaggggcagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtgggtcccatcaaggttcagcggcagtggatctgggagacaattcactctcacaatcagcagcctgcagcctgaagattttgcgacttattactgtcaacaacttaatcgttaccctcttttcggccctgggaccaaagtgatatcaaacgaactgtggctgcaccta

SEQ ID NO: 570171 - DNA, 498 bp, Homo sapiens
  misc_feature: HIJSMM301AIZC7.16.49.E05.1.454.light.4.raw
tgtactactccacgaccggtgctcgatttagagcgactagcaacacacaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttagtaaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggtcggagggaccgaaggtgaccgtcctaggtcagcccaaggct

SEQ ID NO: 570172 - DNA, 500 bp, Homo sapiens
  misc_feature: HIJSMM301BFD6H.48.86.H09.1.454.light.4.raw
agtatacatacacgaccggtgctcgatttagtgctatagacttgggtttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatccttcccgccatctgatatgta

SEQ ID NO: 570173 - DNA, 491 bp, Homo sapiens
  misc_feature: HIJSMM301AFVNO.7.75.G09.1.454.light.4.raw
cgtgtctctacacgaccggtgctcgatttagtatagacatcagggggcaggaaggtcgagacccagtcaggacacagcatggaccatgagggtccccgctcagctcctggggctcctggctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttccggccaggggacacgactggagattaaacgaactgtggctgcaccatctgt

SEQ ID NO: 570174 - DNA, 483 bp, Homo sapiens; identical to SEQ ID NO: 535413
  misc_feature: HIJSMM301BV7GB.26.78.H01.1.454.light.4.raw

SEQ ID NO: 570175 - DNA, 506 bp, Homo sapiens; identical to SEQ ID NO: 559720
  misc_feature: HIJSMM301BGH2Q.15.86.H09.1.454.light.4.raw

SEQ ID NO: 570176 - DNA, 489 bp, Homo sapiens
  misc_feature: HIJSMM301DFENM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttggttctaatcgggcctcggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 570177 - DNA, 493 bp, Homo sapiens
  misc_feature: HIJSMM301DZBAM.16.6.A06.1.454.light.4.raw
  modified_base (399)..(399): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcagttgggaanatgtggcagtttattactgtcagcagtattatactactcctctgacgttcggcaagggaccaaggtgagatcaaacgaactgtggctgcaccat

SEQ ID NO: 570178 - DNA, 515 bp, Homo sapiens
  misc_feature: HIJSMM301BML6K.49.27.C05.1.454.light.4.raw
agtcgagagacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgtt

SEQ ID NO: 570179 - DNA, 490 bp, Homo sapiens
  misc_feature: HIJSMM301C5ZEE.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatggggtgttcggcggagggaccaaacgtgtccgtcctaggtcagaccccg

SEQ ID NO: 570180 - DNA, 501 bp, Homo sapiens; identical to SEQ ID NO: 548357
  misc_feature: HIJSMM301BJ6QQ.19.67.G01.1.454.light.4.raw

SEQ ID NO: 570181 - DNA, 505 bp, Homo sapiens
  misc_feature: HIJSMM301DDMJU.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 570182 - DNA, 494 bp, Homo sapiens; identical to SEQ ID NO: 539922
  misc_feature: HIJSMM301AWZDB.27.78.H01.1.454.light.4.raw

SEQ ID NO: 570183 - DNA, 500 bp, Homo sapiens
  misc_feature: HIJSMM301BF2VL.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggaccgaaaggttgagaccaaacgaaactgtggctgcaccatctgtcttcattccg

SEQ ID NO: 570184 - DNA, 511 bp, Homo sapiens
  misc_feature: HIJSMM301CZH5C.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctcct

SEQ ID NO: 570185 - DNA, 494 bp, Homo sapiens; identical to SEQ ID NO: 535629
  misc_feature: HIJSMM301C1L6B.4.27.C05.1.454.light.4.raw

SEQ ID NO: 570186 - DNA, 495 bp, Homo sapiens
  misc_feature: HIJSMM301BPL20.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagccagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 570187 - DNA, 504 bp, Homo sapiens; identical to SEQ ID NO: 542968
  misc_feature: HIJSMM301AL7VN.11.57.F02.1.454.light.4.raw

SEQ ID NO: 570188 - DNA, 488 bp, Homo sapiens
  misc_feature: HIJSMM301APWOF.49.86.H09.1.454.light.4.raw
agtcgagagacacgaccggtgctcgatttagtgctatagacttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgca

SEQ ID NO: 570189 - DNA, 490 bp, Homo sapiens
  misc_feature: HIJSMM301C3K2N.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggacc

SEQ ID NO: 570190 - DNA, 484 bp, Homo sapiens
  misc_feature: HIJSMM301BGKX4.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagcgtagcaactggcctctcactttcggcggagggaccagggtggagatcagacgaactgtggctgcaccat

SEQ ID NO: 570191 - DNA, 513 bp, Homo sapiens
  misc_feature: HIJSMM301ENYVJ.17.33.C11.1.454.light.4.raw
cgtagactagcacgaccggtgctcgatttagagtgagctcgttgggtttgggggcgccaggggtcccttccaatatcagcaccatagcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 570192 - DNA, 497 bp, Homo sapiens; identical to SEQ ID NO: 538296
  misc_feature: HIJSMM301AIUHA.18.11.A11.1.454.light.4.raw

SEQ ID NO: 570193 - DNA, 488 bp, Homo sapiens; identical to SEQ ID NO: 557159
  misc_feature: HIJSMM301A9XOK.43.33.C11.1.454.light.4.raw

SEQ ID NO: 570194 - DNA, 479 bp, Homo sapiens; identical to SEQ ID NO: 535118
  misc_feature: HIJSMM301BZIWU.13.59.F04.1.454.light.4.raw

SEQ ID NO: 570195 - DNA, 505 bp, Homo sapiens; identical to SEQ ID NO: 535503
  misc_feature: HIJSMM301AMZ51.8.28.C06.1.454.light.4.raw

SEQ ID NO: 570196 - DNA, 495 bp, Homo sapiens
  misc_feature: HIJSMM301A187M.21.27.C05.1.454.light.4.raw
  modified_base (198)..(198): a, c, t, g, unknown or other
  modified_base (361)..(361): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 570197 - DNA, 494 bp, Homo sapiens; identical to SEQ ID NO: 534992
  misc_feature: HIJSMM301DEIQ0.9.1.A01.1.454.light.4.raw

SEQ ID NO: 570198 - DNA, 494 bp, Homo sapiens
  misc_feature: HIJSMM301CJL0C.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctatcttttctcttcggaactgggaccacggtcaccgtcctaggtcagcccaaggcccaaccc

SEQ ID NO: 570199 - DNA, 508 bp, Homo sapiens
  misc_feature: HIJSMM301AKFZG.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccccaaggctgccccccg

SEQ ID NO: 570200 - DNA, 500 bp, Homo sapiens
  misc_feature: HIJSMM301B55JA.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtccaccgtcctaggtcacggcccaagga

SEQ ID NO: 570201 - DNA, 498 bp, Homo sapiens
  misc_feature: HIJSMM301CN9CN.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactagtggctgcaccatctgtcttcatcttccccg

SEQ ID NO: 570202 - DNA, 515 bp, Homo sapiens
  misc_feature: HIJSMM301BZ3DE.22.46.E02.1.454.light.4.raw
  modified_base (499)..(499): a, c, t, g, unknown or other
acatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgccctcaggggtccctgatcgcttctccggctccaagtctggcaacacggcctccctgaccatctctggactccaggctgacgatgagggttgacttttactgctgctcatatgcaggcaactataatatggtcttcggcggagggacccgaaagtagaccgtcctaggtcacgacccaacggcgtncccccctcggtcactt

SEQ ID NO: 570203 - DNA, 521 bp, Homo sapiens
  misc_feature: HIJSMM301AN79X.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccgccctcct

SEQ ID NO: 570204 - DNA, 490 bp, Homo sapiens
  misc_feature: HIJSMM301E2DRL.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtgctgcacat

SEQ ID NO: 570205 - DNA, 497 bp, Homo sapiens; identical to SEQ ID NO: 535829
  misc_feature: HIJSMM301CV1FO.5.24.C02.1.454.light.4.raw

SEQ ID NO: 570206 - DNA, 489 bp, Homo sapiens; identical to SEQ ID NO: 535139
  misc_feature: HIJSMM301A6VIP.14.55.E11.1.454.light.4.raw

SEQ ID NO: 570207 - DNA, 495 bp, Homo sapiens
  misc_feature: HIJSMM301A20ZS.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaacccactgtcactc

SEQ ID NO: 570208 - DNA, 472 bp, Homo sapiens; identical to SEQ ID NO: 542432
  misc_feature: HIJSMM301DRWKJ.13.11.A11.1.454.light.4.raw

SEQ ID NO: 570209 - DNA, 510 bp, Homo sapiens
  misc_feature: HIJSMM301COFCH.13.73.G07.1.454.light.4.raw
tcacgtactacacgaccggtgctcgatttagctctacgctcaggggggggtcacaagaggcagtgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccca

SEQ ID NO: 570210 - DNA, 497 bp, Homo sapiens; identical to SEQ ID NO: 535664
  misc_feature: HIJSMM301BFFFA.22.14.B03.1.454.light.4.raw

SEQ ID NO: 570211 - DNA, 486 bp, Homo sapiens; identical to SEQ ID NO: 535917
  misc_feature: HIJSMM301DXXJX.3.10.A10.1.454.light.4.raw

SEQ ID NO: 570212 - DNA, 474 bp, Homo sapiens; identical to SEQ ID NO: 539713
  misc_feature: HIJSMM301A6V1O.5.28.C06.1.454.light.4.raw

SEQ ID NO: 570213 - DNA, 494 bp, Homo sapiens; identical to SEQ ID NO: 534992
  misc_feature: HIJSMM301BUVYF.9.1.A01.1.454.light.4.raw

SEQ ID NO: 570214 - DNA, 489 bp, Homo sapiens; identical to SEQ ID NO: 536663
  misc_feature: HIJSMM301CFOAR.16.72.G06.1.454.light.4.raw

SEQ ID NO: 570215 - DNA, 511 bp, Homo sapiens
  misc_feature: HIJSMM301CSLAG.8.39.D06.1.454.light.4.raw
ctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcttacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcta

SEQ ID NO: 570216 - DNA, 504 bp, Homo sapiens
  misc_feature: HIJSMM301E0TG5.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccgcctcctcgctacgtaga

SEQ ID NO: 570217 - DNA, 501 bp, Homo sapiens; identical to SEQ ID NO: 536867
  misc_feature: HIJSMM301A7UYJ.5.86.H09.1.454.light.4.raw

SEQ ID NO: 570218 - DNA, 493 bp, Homo sapiens; identical to SEQ ID NO: 535278
  misc_feature: HIJSMM301CPYBZ.51.81.H04.1.454.light.4.raw

SEQ ID NO: 570219 - DNA, 490 bp, Homo sapiens
  misc_feature: HIJSMM301D94AR.40.22.B11.1.454.light.4.raw
tctagcgactcacgaccggtgctcgatttagacgacagctcgagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtcctgacaggttcagtggcagtggatcaggtacagattttacactgaaaatcagcagagtggagctgaggatgttggggtttattactgcatgcaagctctacaaattcctcggacgttcggccaagggaccaaggtggaaatacaacgaactgtggctgcaccat

SEQ ID NO: 570220 - DNA, 486 bp, Homo sapiens; identical to SEQ ID NO: 535043
  misc_feature: HIJSMM301AHYFH.46.35.D02.1.454.light.4.raw

SEQ ID NO: 570221 - DNA, 499 bp, Homo sapiens
  misc_feature: HIJSMM301AKMD4.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagattttgcagtttattactgtcagcagtatgatacctggcctccgtacacttttggccggggaccaagctggaaatcaagcgaactgtggctgcaccatctgtcttcatcttccccg

SEQ ID NO: 570222 - DNA, 466 bp, Homo sapiens; identical to SEQ ID NO: 541765
  misc_feature: HIJSMM301CGNDV.11.70.G04.1.454.light.4.raw

SEQ ID NO: 570223 - DNA, 496 bp, Homo sapiens; identical to SEQ ID NO: 537925
  misc_feature: HIJSMM301C9U2Q.22.14.B03.1.454.light.4.raw

SEQ ID NO: 570224 - DNA, 488 bp, Homo sapiens; identical to SEQ ID NO: 537673
  misc_feature: HIJSMM301EVN9R.12.31.C09.1.454.light.4.raw

SEQ ID NO: 570225 - DNA, 511 bp, Homo sapiens; identical to SEQ ID NO: 537464
  misc_feature: HIJSMM301A7XKX.7.34.D01.1.454.light.4.raw

SEQ ID NO: 570226 - DNA, 496 bp, Homo sapiens; identical to SEQ ID NO: 559735
  misc_feature: HIJSMM301DN6AW.13.38.D05.1.454.light.4.raw

SEQ ID NO: 570227 - DNA, 511 bp, Homo sapiens
  misc_feature: HIJSMM301BIVEX.51.64.F09.1.454.light.4.raw
cgatcgtatacacgaccggtgctcgatttagcgcgtatacaagggggaggaactgctcagttaggacccagagggaaccatggaaaccccagcgcagcttctcttcctcctgctactctggctcccagatactaccggagaaattgtgttgacgcaatcgccaggcaccctgtctttgtctccaggggagagagccaccctctcttgcagggccagtcagactattggcatcaactacctagcctggtaccaacagaagcctggccaggctcccagactcctcctttttggtgcatccagcagggccactggcgtcccagacaggttcagtggcagtgggtctgggacagacttcgctctcaccatcagcagagtggagcctgaagattttgcagtgtattactgtcagcagtataatctactacctcggacgttcggcccacgggaccaaggtggaaagtacaaacgaaactgtggcgtgcaccatctgtcttcactcttcccgtccact

SEQ ID NO: 570228 - DNA, 498 bp, Homo sapiens; identical to SEQ ID NO: 553891
  misc_feature: HIJSMM301AKSEL.3.33.C11.1.454.light.4.raw

SEQ ID NO: 570229 - DNA, 485 bp, Homo sapiens
  misc_feature: HIJSMM301C23S3.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccat

SEQ ID NO: 570230 - DNA, 506 bp, Homo sapiens
  misc_feature: HIJSMM301CV4L8.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgtcagcgtgggatgacggtctgagtgctgtggtcttcggcggagggaacaagctgaccgtcctgggtcagcccaaggctgccccctcggtcact

SEQ ID NO: 570231 - DNA, 460 bp, Homo sapiens
  misc_feature: HIJSMM301COJHD.51.48.E04.1.454.light.4.raw
cgatcgtatacacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 570232 - DNA, 504 bp, Homo sapiens
  misc_feature: HIJSMM301CJM97.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 570233 - DNA, 484 bp, Homo sapiens; identical to SEQ ID NO: 536162
  misc_feature: HIJSMM301AUYEH.13.59.F04.1.454.light.4.raw

SEQ ID NO: 570234 - DNA, 509 bp, Homo sapiens
  misc_feature: HIJSMM301EONCB.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacaggacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 570235 - DNA, 518 bp, Homo sapiens; identical to SEQ ID NO: 539372
  misc_feature: HIJSMM301BGOAK.7.86.H09.1.454.light.4.raw

SEQ ID NO: 570236 - DNA, 507 bp, Homo sapiens
  misc_feature: HIJSMM301ADTRY.9.1.A01.1.454.light.4.raw
  modified_base (476)..(476): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaacctcgtccaacggacgacgactaggagattaaaggtaaacgtaagtaggngtgcgacactactcgtcttctatacttcccg

SEQ ID NO: 570237 - DNA, 505 bp, Homo sapiens; identical to SEQ ID NO: 535987
  misc_feature: HIJSMM301BW1P6.18.37.D04.1.454.light.4.raw

SEQ ID NO: 570238 - DNA, 479 bp, Homo sapiens; identical to SEQ ID NO: 538734
  misc_feature: HIJSMM301ELDBK.8.53.E09.1.454.light.4.raw

SEQ ID NO: 570239 - DNA, 509 bp, Homo sapiens; identical to SEQ ID NO: 547302
  misc_feature: HIJSMM301A5LOQ.4.57.F02.1.454.light.4.raw

SEQ ID NO: 570240 - DNA, 521 bp, Homo sapiens; identical to SEQ ID NO: 539470
  misc_feature: HIJSMM301EQABM.27.23.C01.1.454.light.4.raw

SEQ ID NO: 570241 - DNA, 493 bp, Homo sapiens; identical to SEQ ID NO: 536471
  misc_feature: HIJSMM301ALLHX.3.71.G05.1.454.light.4.raw

SEQ ID NO: 570242 - DNA, 489 bp, Homo sapiens
  misc_feature: HIJSMM301AUSEM.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttatactgtcagcaatattatagtactcctccgaggctcactttcggcggagggaccaaggtggagatcaacgaa

SEQ ID NO: 570243 - DNA, 501 bp, Homo sapiens
  misc_feature: HIJSMM301B3JCB.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagccaaggctgccccctcggtc

SEQ ID NO: 570244 - DNA, 493 bp, Homo sapiens; identical to SEQ ID NO: 537422
  misc_feature: HIJSMM301AIOZX.9.34.D01.1.454.light.4.raw

SEQ ID NO: 570245 - DNA, 470 bp, Homo sapiens; identical to SEQ ID NO: 561850
  misc_feature: HIJSMM301AH3W5.51.67.G01.1.454.light.4.raw

SEQ ID NO: 570246 - DNA, 518 bp, Homo sapiens
  misc_feature: HIJSMM301A5SS6.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtcacggaccgaacggtaggaagtacgtaacgaaactaacgtggcgtgcaccactctgtcttctatcttcccgtccactt

SEQ ID NO: 570247 - DNA, 473 bp, Homo sapiens
  misc_feature: HIJSMM301CYG4I.48.33.C11.1.454.light.4.raw
agtatacatacacgaccggtgctcgatttagagtgagctcgttgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggcctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 570248 - DNA, 491 bp, Homo sapiens; identical to SEQ ID NO: 535194
  misc_feature: HIJSMM301B91VE.26.78.H01.1.454.light.4.raw

SEQ ID NO: 570249 - DNA, 416 bp, Homo sapiens
  misc_feature: HIJSMM301B00X0.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 570250 - DNA, 508 bp, Homo sapiens; identical to SEQ ID NO: 540640
  misc_feature: HIJSMM301BO3CD.5.60.F05.1.454.light.4.raw

SEQ ID NO: 570251 - DNA, 501 bp, Homo sapiens
  misc_feature: HIJSMM301D6YR3.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtcgtcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctcgttcccgccctcctctgtcgagcgt

SEQ ID NO: 570252 - DNA, 503 bp, Homo sapiens
  misc_feature: HIJSMM301EXHFK.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccac

SEQ ID NO: 570253 - DNA, 447 bp, Homo sapiens
  misc_feature: HIJSMM301EEBXB.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcggcggagggaccaggctgaccgtcgcgggtcagcccaaggctgccccctcggtcactctgttcccgccctcctccatactcgta

SEQ ID NO: 570254 - DNA, 493 bp, Homo sapiens; identical to SEQ ID NO: 536246
  misc_feature: HIJSMM301AIO5V.49.66.F11.1.454.light.4.raw

SEQ ID NO: 570255 - DNA, 512 bp, Homo sapiens; identical to SEQ ID NO: 536795
  misc_feature: HIJSMM301CUAZX.15.76.G10.1.454.light.4.raw

SEQ ID NO: 570256 - DNA, 484 bp, Homo sapiens; identical to SEQ ID NO: 535400
  misc_feature: HIJSMM301DLYGA.46.26.C04.1.454.light.4.raw

SEQ ID NO: 570257 - DNA, 482 bp, Homo sapiens
  misc_feature: HIJSMM301C7HI7.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacc

SEQ ID NO: 570258 - DNA, 464 bp, Homo sapiens
  misc_feature: HIJSMM301DOENM.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaaagtggggtcccatcaaggttcagtggcagtggatctgggacagatttcactctcaccatcaacagtctgcaacctgaagattttgcaacttactaactgtcaacagaagtttcactaccctctcactttcgcgggccggaaggaggagag

SEQ ID NO: 570259 - DNA, 480 bp, Homo sapiens
  misc_feature: HIJSMM301AXLQW.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgctagtttattactgtcagcagtatgatgactggcctcagacgttcggccaagggaccaaggtggaagtcaaacgaactgtggctgcaccat

SEQ ID NO: 570260 - DNA, 489 bp, Homo sapiens; identical to SEQ ID NO: 544582
  misc_feature: HIJSMM301EOV0R.22.65.F10.1.454.light.4.raw

SEQ ID NO: 570261 - DNA, 484 bp, Homo sapiens; identical to SEQ ID NO: 535240
  misc_feature: HIJSMM301DIAQL.47.60.F05.1.454.light.4.raw

SEQ ID NO: 570262 - DNA, 489 bp, Homo sapiens
  misc_feature: HIJSMM301DMFAW.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacacttccccctcactttcggcggagggaccaaggtggagatcaagcgaactgtggctgcaccatctgtctt

SEQ ID NO: 570263 - DNA, 486 bp, Homo sapiens
  misc_feature: HIJSMM301DU42N.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaaacgaactgtggctgcaccatctgt

SEQ ID NO: 570264 - DNA, 504 bp, Homo sapiens; identical to SEQ ID NO: 540689
  misc_feature: HIJSMM301DZO4B.21.38.D05.1.454.light.4.raw

SEQ ID NO: 570265 - DNA, 497 bp, Homo sapiens; identical to SEQ ID NO: 536376
  misc_feature: HIJSMM301CT1LP.22.9.A09.1.454.light.4.raw

SEQ ID NO: 570266 - DNA, 507 bp, Homo sapiens; identical to SEQ ID NO: 535641
  misc_feature: HIJSMM301C04AI.10.88.H11.1.454.light.4.raw

SEQ ID NO: 570267 - DNA, 499 bp, Homo sapiens
  misc_feature: HIJSMM301BLDIX.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggaccagatttcgactctcaccatcagcagcctgcaggctgaagatgtggcagtttattactgtcagcaatattatagtactcctccgaggctcactttcggcggagggaccaaggtggagatcaaacgaactgtc

SEQ ID NO: 570268 - DNA, 514 bp, Homo sapiens
  misc_feature: HIJSMM301EVY2N.49.23.C01.1.454.light.4.raw
agtcgagagacacgaccggtgctcgatttagtacacgtgattagggattgggggggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactcctgttcccaccctcct

SEQ ID NO: 570269 - DNA, 514 bp, Homo sapiens
  misc_feature: HIJSMM301EM3FX.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccacctcct

SEQ ID NO: 570270 - DNA, 501 bp, Homo sapiens
  misc_feature: HIJSMM301CNHO8.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcttccctgacaatctctgggctccaggctgaggacgaggctgattattattgctgctcatatgcaggtagttacacttatgtcttcggaattgggacgacggtcaccgtcctaggtcagcccaaggcccaaccccta

SEQ ID NO: 570271 - DNA, 528 bp, Homo sapiens
  misc_feature: HIJSMM301B7TFF.41.73.G07.1.454.light.4.raw
tctatactatcacgaccggtgctcgatttagctctacgctcagggcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtgggtcccgttcaaggttcagtggcagtggatctgggacagagttcaccctcaccatcggcagcctgcagcctgaagatatcgcaacttattactgtcaacaatataacacttattctaggggacgattcggtccgaacgggaaacccggaacggtagggtaaaagttaaaacgtaaaaccgt

SEQ ID NO: 570272 - DNA, 519 bp, Homo sapiens
  misc_feature: HIJSMM301BAW3M.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccaaggtgaccgtcctaagtcagcccaaggctgccccctcggtcactctgttcccaccct

SEQ ID NO: 570273 - DNA, 490 bp, Homo sapiens
  misc_feature: HIJSMM301EGG00.49.46.E02.1.454.light.4.raw
agtcgagagacacgaccggtgctcgatttagactcatctacagggaaagggggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatacaaacgaactgtggctgcaccatctgtctt

SEQ ID NO: 570274 - DNA, 494 bp, Homo sapiens; identical to SEQ ID NO: 535276
  misc_feature: HIJSMM301AZVAC.16.6.A06.1.454.light.4.raw

SEQ ID NO: 570275 - DNA, 407 bp, Homo sapiens; identical to SEQ ID NO: 536776
  misc_feature: HIJSMM301EOUU8.40.8.A08.1.454.light.4.raw

SEQ ID NO: 570276 - DNA, 502 bp, Homo sapiens; identical to SEQ ID NO: 541501
  misc_feature: HIJSMM301AX6P4.17.27.C05.1.454.light.4.raw

SEQ ID NO: 570277 - DNA, 464 bp, Homo sapiens
  misc_feature: HIJSMM301EQNIU.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagccccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 570278 - DNA, 475 bp, Homo sapiens
  misc_feature: HIJSMM301B976P.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaactgtggctgcacc

SEQ ID NO: 570279 - DNA, 441 bp, Homo sapiens; identical to SEQ ID NO: 534971
  misc_feature: HIJSMM301CPATL.11.3.A03.1.454.light.4.raw

SEQ ID NO: 570280 - DNA, 511 bp, Homo sapiens
  misc_feature: HIJSMM301EPNCZ.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagccaaggctgcccctcggtcactctgttcccaccctcct

SEQ ID NO: 570281 - DNA, 506 bp, Homo sapiens; identical to SEQ ID NO: 545686
  misc_feature: HIJSMM301EZSC7.18.37.D04.1.454.light.4.raw

SEQ ID NO: 570282 - DNA, 494 bp, Homo sapiens
  misc_feature: HIJSMM301DQD3O.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggtcagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 570283 - DNA, 517 bp, Homo sapiens
  misc_feature: HIJSMM301AXIYI.48.20.B09.1.454.light.4.raw
agtatacatacacgaccggtgctcgatttagtgtagtgtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccct

SEQ ID NO: 570284 - DNA, 480 bp, Homo sapiens
  misc_feature: HIJSMM301BXCQ1.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgcccccc

SEQ ID NO: 570285 - DNA, 490 bp, Homo sapiens; identical to SEQ ID NO: 546873
  misc_feature: HIJSMM301CWYJT.5.55.E11.1.454.light.4.raw

SEQ ID NO: 570286 - DNA, 494 bp, Homo sapiens
  misc_feature: HIJSMM301A7R8C.27.78.H01.1.454.light.4.raw
agcgtcgtctcacgaccggtgctcgatttagtgtgagtagtttgggtttggggatgagacaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagataaacgaactgtgctgcaccatctgtctt

SEQ ID NO: 570287 - DNA, 483 bp, Homo sapiens
  misc_feature: HIJSMM301DD5N5.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctcg

SEQ ID NO: 570288 - DNA, 486 bp, Homo sapiens; identical to SEQ ID NO: 535043
  misc_feature: HIJSMM301DIJ3E.46.35.D02.1.454.light.4.raw

SEQ ID NO: 570289 - DNA, 500 bp, Homo sapiens
  misc_feature: HIJSMM301CYCGK.48.37.D04.1.454.light.4.raw
agtatacatacacgaccggtgctcgatttagtagcatactgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 570290 - DNA, 513 bp, Homo sapiens
  misc_feature: HIJSMM301ANNNE.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtccactc

SEQ ID NO: 570291 - DNA, 501 bp, Homo sapiens; identical to SEQ ID NO: 535509
  misc_feature: HIJSMM301DZPZQ.15.56.F01.1.454.light.4.raw

SEQ ID NO: 570292 - DNA, 485 bp, Homo sapiens
  misc_feature: HIJSMM301ADEWC.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggacgaacggtggaggatcaaacgaactagtggctgcaccta

SEQ ID NO: 570293 - DNA, 496 bp, Homo sapiens; identical to SEQ ID NO: 566097
  misc_feature: HIJSMM301BLFKJ.5.12.B01.1.454.light.4.raw

SEQ ID NO: 570294 - DNA, 488 bp, Homo sapiens; identical to SEQ ID NO: 535861
  misc_feature: HIJSMM301CUK5W.14.55.E11.1.454.light.4.raw

SEQ ID NO: 570295 - DNA, 484 bp, Homo sapiens; identical to SEQ ID NO: 537878
  misc_feature: HIJSMM301C0BAC.17.34.D01.1.454.light.4.raw

SEQ ID NO: 570296 - DNA, 476 bp, Homo sapiens
  misc_feature: HIJSMM301BLEOY.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgttttggtccaggggaccgaaggtggagatcaaacgaactagtggctgcaccat

SEQ ID NO: 570297 - DNA, 490 bp, Homo sapiens; identical to SEQ ID NO: 536481
  misc_feature: HIJSMM301DYAA4.13.46.E02.1.454.light.4.raw

SEQ ID NO: 570298 - DNA, 504 bp, Homo sapiens
  misc_feature: HIJSMM301E01MO.9.12.B01.1.454.light.4.raw
tgatacgtctcacgaccggtgctcgatttagtagtgtagattccgcggggacaacaggcaggcaggggcagcaaagatggtgtttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaaatcaaacgaactagtggctgcaccatctgtcttcatcttccccg

SEQ ID NO: 570299 - DNA, 503 bp, Homo sapiens; identical to SEQ ID NO: 535140
  misc_feature: HIJSMM301DN0SR.18.37.D04.1.454.light.4.raw

SEQ ID NO: 570300 - DNA, 484 bp, Homo sapiens
  misc_feature: HIJSMM301BF0J0.4.1.A01.1.454.light.4.raw
agcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggctaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcta

SEQ ID NO: 570301 - DNA, 512 bp, Homo sapiens
  misc_feature: HIJSMM301C3Y2S.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccatgttgcaccgcaaagcgggaccagaccctggagcctcagttggaagcagccgatccagcctgcggagcctgtgggcaggtcagcccaaggctgccccctcggtcactctgttcccaccctcctccacg

SEQ ID NO: 570302 - DNA, 492 bp, Homo sapiens; identical to SEQ ID NO: 550823
  misc_feature: HIJSMM301D2SYD.49.20.B09.1.454.light.4.raw

SEQ ID NO: 570303 - DNA, 468 bp, Homo sapiens
  misc_feature: HIJSMM301DEVME.49.75.G09.1.454.light.4.raw
agtcgagagacacgaccggtgctcgatttagtatagacatcaggggggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccaaggtggagatccagcgaactgtggctgcaccatctgtcttcatcttcccgccatctgatct

SEQ ID NO: 570304 - DNA, 456 bp, Homo sapiens
  misc_feature: HIJSMM301D997N.49.85.H08.1.454.light.4.raw
agtcgagagacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctggccatcagcgggactcaggctatcgatgaggctgactattactgtcaggcgtgggacagccgcactggggtattcggcggagggaccaagctgaccgt

SEQ ID NO: 570305 - DNA, 493 bp, Homo sapiens; identical to SEQ ID NO: 542962
  misc_feature: HIJSMM301EC1DM.14.53.E09.1.454.light.4.raw

SEQ ID NO: 570306 - DNA, 501 bp, Homo sapiens
  misc_feature: HIJSMM301A24QO.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctacaccatctgtcttcatcttcccg

SEQ ID NO: 570307 - DNA, 495 bp, Homo sapiens; identical to SEQ ID NO: 536055
  misc_feature: HIJSMM301BWQ4E.47.38.D05.1.454.light.4.raw

SEQ ID NO: 570308 - DNA, 504 bp, Homo sapiens; identical to SEQ ID NO: 535128
  misc_feature: HIJSMM301E0JFD.19.85.H08.1.454.light.4.raw

SEQ ID NO: 570309 - DNA, 486 bp, Homo sapiens; identical to SEQ ID NO: 535043
  misc_feature: HIJSMM301EMSL8.46.35.D02.1.454.light.4.raw

SEQ ID NO: 570310 - DNA, 487 bp, Homo sapiens; identical to SEQ ID NO: 544685
  misc_feature: HIJSMM301A856M.15.28.C06.1.454.light.4.raw

SEQ ID NO: 570311 - DNA, 504 bp, Homo sapiens
  misc_feature: HIJSMM301BRX14.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaagtggagatcaaacgaactagtggctgcacc

SEQ ID NO: 570312 - DNA, 499 bp, Homo sapiens
  misc_feature: HIJSMM301CPP92.15.67.G01.1.454.light.4.raw
tctacgtagccacgaccggtgctcgatttagagtatacatattgggtttggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgtcgtcgtacggacggaacggtaggaaaggtacaaacgaactaacgtaggtcgtgtcgacca

SEQ ID NO: 570313 - DNA, 487 bp, Homo sapiens; identical to SEQ ID NO: 537573
  misc_feature: HIJSMM301CMX98.3.10.A10.1.454.light.4.raw

SEQ ID NO: 570314 - DNA, 481 bp, Homo sapiens; identical to SEQ ID NO: 545581
  misc_feature: HIJSMM301C1W0H.48.19.B08.1.454.light.4.raw

SEQ ID NO: 570315 - DNA, 505 bp, Homo sapiens; identical to SEQ ID NO: 536254
  misc_feature: HIJSMM301D1VOK.7.71.G05.1.454.light.4.raw

SEQ ID NO: 570316 - DNA, 484 bp, Homo sapiens; identical to SEQ ID NO: 535400
  misc_feature: HIJSMM301BIP7N.46.26.C04.1.454.light.4.raw

SEQ ID NO: 570317 - DNA, 497 bp, Homo sapiens
  misc_feature: HIJSMM301ASCEY.41.74.G08.1.454.light.4.raw
  modified_base (491)..(491): a, c, t, g, unknown or other
tctatactatcacgaccggtgctcgatttagtagctctatcagggggagctacaacaggcaggcaggggcagcaagatggtgttgcagacccaggtcttcatttctctgttgctctggatctctggcgcctacggggacatcgtgatgacccagtctccagactccctggcagtgtctctgggcgggagggccaccatcaactgcaagtccagccagactattttatacggctcctacaataagaacgacttagcttggtaccagcagaaaccaggacagcctcctaagttgctcatttactgggcatctaaccgcatatccggtgtccctgaccgattcaatgccagcgggtctgggacagatttcactctcaccatcagcagcctgcaggctgaggatgtggcagtttattactgtcatcaatattatactactccgtggacgttcggccaagggaccaaggtggaattgaaacggaactgtggctggnacccta

SEQ ID NO: 570318 - DNA, 493 bp, Homo sapiens
  misc_feature: HIJSMM301EZE1C.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcacctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 570319 - DNA, 488 bp, Homo sapiens
  misc_feature: HIJSMM301C00Y6.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgagggatgttggggtttattactgcatgcaagttctacaaacttcctacacttttggccaggggaccaagctggagatcaaacgaa

SEQ ID NO: 570320 - DNA, 501 bp, Homo sapiens
  misc_feature: HIJSMM301A3C7H.41.67.G01.1.454.light.4.raw
tctatactatcacgaccggtgctcgatttagagtatacatattgggtttgggggagtcagacccagtcaggacacagcatggacatgagggtccccgctcagctcctggggctcctgctgctctggctcccaggtgcgaaatgtgacatccagatgacccagtctccttccaccctgtctgcatttgtagtagacagagtcaccatcacttgccgggccagtcagagtcttagtaattggttggcctgctatcagcggaaaccggggaaagaccgtaacctcctcatgtctaacccatccactttagaaactggggccccatcaaggttcagcggccgtggatctggggacagaattcactctcaccatcagcagcctgcagcctgagaattttgcaaattgtcactaccaacagtttagttcttattcatattcggcggagggaccagggtcgaggtcaaacgaactgtggctgcaccatctgtcttcatcttcccgcat

SEQ ID NO: 570321 - DNA, 440 bp, Homo sapiens
  misc_feature: HIJSMM301C1F9T.17.11.A11.1.454.light.4.raw
cgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggaggctgaggatgttggggtttattactgcttgcaaggtacacactggtacacttttggccaggggaccaagctggagatcaaacgaactgtggctgcaccatctgtcttcatcttcccgccatctgactagtctacg

SEQ ID NO: 570322 - DNA, 486 bp, Homo sapiens
  misc_feature: HIJSMM301ESVAJ.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggtcggagggaccgaaggtggagatcaaacgaaactagtggctgcaccc

SEQ ID NO: 570323 - DNA, 496 bp, Homo sapiens; identical to SEQ ID NO: 537925
  misc_feature: HIJSMM301EP9UA.22.14.B03.1.454.light.4.raw

SEQ ID NO: 570324 - DNA, 478 bp, Homo sapiens
  misc_feature: HIJSMM301CK5A4.52.10.A10.1.454.light.4.raw
cgcagtacgacacgaccggtgctcgatttagcgtcgatctcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccat

SEQ ID NO: 570325 - DNA, 476 bp, Homo sapiens; identical to SEQ ID NO: 538611
  misc_feature: HIJSMM301AZUH9.7.81.H04.1.454.light.4.raw

SEQ ID NO: 570326 - DNA, 519 bp, Homo sapiens
  misc_feature: HIJSMM301C80HU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaactagttttctcgggcgttcggccgaacgggaccgaaggtaggaaatacgaaaacgaaaccgtagtggcgtgcgaccactctgtcttctatcttccccg

SEQ ID NO: 570327 - DNA, 481 bp, Homo sapiens
  misc_feature: HIJSMM301AP3EO.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcaccat

SEQ ID NO: 570328 - DNA, 503 bp, Homo sapiens
  misc_feature: HIJSMM301CAP77.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagccaaggctgccccctcggtcactctgttcccaccctcctcacg

SEQ ID NO: 570329 - DNA, 454 bp, Homo sapiens
  misc_feature: HIJSMM301DAI0Y.19.86.H09.1.454.light.4.raw
tactctcgtgcacgaccggtgctcgatttagtgctatagacttgggtttgggggccgttcctgggcccagtctgtgctgactcagacaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggccgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 570330 - DNA, 444 bp, Homo sapiens
  misc_feature: HIJSMM301C88VE.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaaggctgaccgtcctaggtcagcccaaggctgccccctcggtcactctgttcccaccctcctcagacgtatca

SEQ ID NO: 570331 - DNA, 521 bp, Homo sapiens; identical to SEQ ID NO: 539946
  misc_feature: HIJSMM301B8FA5.5.27.C05.1.454.light.4.raw

SEQ ID NO: 570332 - DNA, 493 bp, Homo sapiens
  misc_feature: HIJSMM301BW8MX.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttccgccat

SEQ ID NO: 570333 - DNA, 474 bp, Homo sapiens
  misc_feature: HIJSMM301DB45C.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggaccaggctatggatgaggctgactattactgtcaggcgtgggacagcagcactgcccgctatgtcttcggaactgggaccaaggtcaccgtcctaagtcagcccaac

SEQ ID NO: 570334 - DNA, 406 bp, Homo sapiens
  misc_feature: HIJSMM301B834Q.43.34.D01.1.454.light.4.raw
tgtgagtagtcacgaccggtgctcgatttagatcgtctgtgttgggtttgggggctttgcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtcagcccaaggccaaccccactgtcactctgttcccaccctcctcactactcaca

SEQ ID NO: 570335 - DNA, 491 bp, Homo sapiens; identical to SEQ ID NO: 535294
  misc_feature: HIJSMM301ELU47.16.68.G02.1.454.light.4.raw

SEQ ID NO: 570336 - DNA, 497 bp, Homo sapiens
  misc_feature: HIJSMM301CHW4B.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcagacggaagatgaggctgactattactgtaactcccgggccagcagtggtaacattgtgatattcggcggagggaccaaggtgaccgtcctacgtcagcccaaggctgccccctcggtcactctcg

SEQ ID NO: 570337 - DNA, 476 bp, Homo sapiens; identical to SEQ ID NO: 537368
  misc_feature: HIJSMM301D8N95.7.83.H06.1.454.light.4.raw

SEQ ID NO: 570338 - DNA, 486 bp, Homo sapiens; identical to SEQ ID NO: 535385
  misc_feature: HIJSMM301B1DLE.19.71.G05.1.454.light.4.raw

SEQ ID NO: 570339 - DNA, 497 bp, Homo sapiens; identical to SEQ ID NO: 555392
  misc_feature: HIJSMM301AGJGC.43.71.G05.1.454.light.4.raw

SEQ ID NO: 570340 - DNA, 505 bp, Homo sapiens; identical to SEQ ID NO: 536254
  misc_feature: HIJSMM301CF8M1.7.71.G05.1.454.light.4.raw

SEQ ID NO: 570341 - DNA, 494 bp, Homo sapiens; identical to SEQ ID NO: 535276
  misc_feature: HIJSMM301AR15N.16.6.A06.1.454.light.4.raw

SEQ ID NO: 570342 - DNA, 521 bp, Homo sapiens; identical to SEQ ID NO: 536990
  misc_feature: HIJSMM301EOK2M.27.23.C01.1.454.light.4.raw
  modified_base (517)..(517): a, c, t, g, unknown or other

SEQ ID NO: 570343 - DNA, 440 bp, Homo sapiens
  misc_feature: HIJSMM301D2IP7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttccgccctcctccatactcgta

SEQ ID NO: 570344 - DNA, 489 bp, Homo sapiens
  misc_feature: HIJSMM301CYWI0.49.72.G06.1.454.light.4.raw
agtcgagagacacgaccggtgctcgatttagctacgactgcaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgtaacg

SEQ ID NO: 570345 - DNA, 504 bp, Homo sapiens; identical to SEQ ID NO: 536469
  misc_feature: HIJSMM301B83RO.52.36.D03.1.454.light.4.raw

SEQ ID NO: 570346 - DNA, 513 bp, Homo sapiens
  misc_feature: HIJSMM301CGIFA.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccgaggtaggagatcaagcgaactgtggctgcaccatctgtcttctatctttcccgccact

SEQ ID NO: 570347 - DNA, 491 bp, Homo sapiens
  misc_feature: HIJSMM301DFYW6.48.27.C05.1.454.light.4.raw
agtatacatacacgaccggtgctcgatttagacgcgatcgaagggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagccccg

SEQ ID NO: 570348 - DNA, 476 bp, Homo sapiens; identical to SEQ ID NO: 537368
  misc_feature: HIJSMM301A7UBW.7.83.H06.1.454.light.4.raw

SEQ ID NO: 570349 - DNA, 496 bp, Homo sapiens
  misc_feature: HIJSMM301B2AX6.51.35.D02.1.454.light.4.raw
  modified_base (487)..(487): a, c, t, g, unknown or other
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccnctgtcactc

SEQ ID NO: 570350 - DNA, 476 bp, Homo sapiens; identical to SEQ ID NO: 538611
  misc_feature: HIJSMM301A3ACO.7.81.H04.1.454.light.4.raw

SEQ ID NO: 570351 - DNA, 488 bp, Homo sapiens; identical to SEQ ID NO: 535081
  misc_feature: HIJSMM301DZHEK.26.23.C01.1.454.light.4.raw

SEQ ID NO: 570352 - DNA, 494 bp, Homo sapiens
  misc_feature: HIJSMM301BY4R0.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcact

SEQ ID NO: 570353 - DNA, 489 bp, Homo sapiens; identical to SEQ ID NO: 542780
  misc_feature: HIJSMM301AYJCU.16.53.E09.1.454.light.4.raw

SEQ ID NO: 570354 - DNA, 494 bp, Homo sapiens
  misc_feature: HIJSMM301DP7NY.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttatactgtcagcagcacagcaactggttactctctttcggcggagggaccaaggtggagatcaaacgaactgtggctgcaccatctgtcttca

SEQ ID NO: 570355 - DNA, 503 bp, Homo sapiens
  misc_feature: HIJSMM301CCT1P.19.78.H01.1.454.light.4.raw
  modified_base (497)..(497): a, c, t, g, unknown or other
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccnctgtca

SEQ ID NO: 570356 - DNA, 453 bp, Homo sapiens
  misc_feature: HIJSMM301DJN68.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaatggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 570357 - DNA, 485 bp, Homo sapiens; identical to SEQ ID NO: 536040
  misc_feature: HIJSMM301AQ5ZE.15.1.A01.1.454.light.4.raw

SEQ ID NO: 570358 - DNA, 493 bp, Homo sapiens
  misc_feature: HIJSMM301E2A62.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggagatcaaacgaactagtgg

SEQ ID NO: 570359 - DNA, 447 bp, Homo sapiens; identical to SEQ ID NO: 535020
  misc_feature: HIJSMM301AX1EB.18.9.A09.1.454.light.4.raw

SEQ ID NO: 570360 - DNA, 487 bp, Homo sapiens; identical to SEQ ID NO: 550345
  misc_feature: HIJSMM301A70SL.14.68.G02.1.454.light.4.raw

SEQ ID NO: 570361 - DNA, 505 bp, Homo sapiens
  misc_feature: HIJSMM301AUOG7.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccgaggctgaccgtcggcggtcagcccaaggctcgccccctcggtcactctgttcccaccctcct

SEQ ID NO: 570362 - DNA, 493 bp, Homo sapiens
  misc_feature: HIJSMM301B8CR5.22.25.C03.1.454.light.4.raw
acatacgcgtcacgaccggtgctcgatttagtagtgtagatttgggtttgggggcaggagccagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatacaaacgaactgtggctgcaccatctgtt

SEQ ID NO: 570363 - DNA, 518 bp, Homo sapiens
  misc_feature: HIJSMM301A2UFK.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaaagccggggatgaggccgactattactgtcaggtgtggaatggtgattatgattatgtcttcggaactgggaccaaggtcaccgtcctaggtcagccaaggccaacccactgtcactctgttcccgccctcctccgtgt

SEQ ID NO: 570364 - DNA, 485 bp, Homo sapiens
  misc_feature: HIJSMM301BPJQ8.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcacca

SEQ ID NO: 570365 - DNA, 486 bp, Homo sapiens
  misc_feature: HIJSMM301EPQRH.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggtttattactgcatgcaagttctacaaaacttcctacacttttggccagggaccaagctggagatcaaacgaa

SEQ ID NO: 570366 - DNA, 444 bp, Homo sapiens; identical to SEQ ID NO: 536484
  misc_feature: HIJSMM301BTN8A.8.11.A11.1.454.light.4.raw

SEQ ID NO: 570367 - DNA, 494 bp, Homo sapiens
  misc_feature: HIJSMM301C38P7.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcagcagtataataactggttcctgctcactttcggcgggggaccaaggtggagatcaaacgaactgtggctgcaccatctgtt

SEQ ID NO: 570368 - DNA, 508 bp, Homo sapiens
  misc_feature: HIJSMM301DBRZS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccgaaggtaggaaagtacaaacgaactgtggctgcaccatctgtcttctatcttccccg

SEQ ID NO: 570369 - DNA, 487 bp, Homo sapiens
  misc_feature: HIJSMM301A6IGP.46.35.D02.1.454.light.4.raw
actagcagtacacgaccggtgctcgatttagcacacgatagttgggtttgggggagctgctcagttaggacccagagggaaccatggaaaccccagcgcagccttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 570370 - DNA, 473 bp, Homo sapiens; identical to SEQ ID NO: 535262
  misc_feature: HIJSMM301AG522.8.67.G01.1.454.light.4.raw

SEQ ID NO: 570371 - DNA, 501 bp, Homo sapiens
  misc_feature: HIJSMM301CV1IU.48.58.F03.1.454.light.4.raw
agtatacatacacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactgtggctgcaccat

SEQ ID NO: 570372 - DNA, 478 bp, Homo sapiens
  misc_feature: HIJSMM301CWSKF.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtggctgca

SEQ ID NO: 570373 - DNA, 503 bp, Homo sapiens
  misc_feature: HIJSMM301B4KU3.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccc

SEQ ID NO: 570374 - DNA, 441 bp, Homo sapiens
  misc_feature: HIJSMM301CTMS4.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctcgttcccaccctcctcatagtataga

SEQ ID NO: 570375 - DNA, 485 bp, Homo sapiens; identical to SEQ ID NO: 536576
  misc_feature: HIJSMM301DC6Z7.46.35.D02.1.454.light.4.raw

SEQ ID NO: 570376 - DNA, 492 bp, Homo sapiens
  misc_feature: HIJSMM301AMP3B.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacggggaccgacggtcggagtgtctaagacgaactagtggcgtgcaccact

SEQ ID NO: 570377 - DNA, 484 bp, Homo sapiens
  misc_feature: HIJSMM301B4CGT.51.52.E08.1.454.light.4.raw
cgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgacttattactgttactctgcggctgacaacaattctgggatattcggcggagggaccaagctgaccgtcttaggtcagcccaaggctcg

SEQ ID NO: 570378 - DNA, 504 bp, Homo sapiens; identical to SEQ ID NO: 541722
  misc_feature: HIJSMM301C12JX.48.34.D01.1.454.light.4.raw

SEQ ID NO: 570379 - DNA, 499 bp, Homo sapiens
  misc_feature: HIJSMM301DEC9P.51.59.F04.1.454.light.4.raw
cgatcgtatacacgaccggtgctcgatttagtacacacacttagggattgggggtgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgaccaaggtcaccgtcctgggtcagcccaaggccaaccccactgtca

SEQ ID NO: 570380 - DNA, 494 bp, Homo sapiens; identical to SEQ ID NO: 534994
  misc_feature: HIJSMM301CLVLS.27.78.H01.1.454.light.4.raw

SEQ ID NO: 570381 - DNA, 447 bp, Homo sapiens; identical to SEQ ID NO: 535201
  misc_feature: HIJSMM301A0E7C.18.9.A09.1.454.light.4.raw

SEQ ID NO: 570382 - DNA, 492 bp, Homo sapiens; identical to SEQ ID NO: 534967
  misc_feature: HIJSMM301DPPRY.47.64.F09.1.454.light.4.raw

SEQ ID NO: 570383 - DNA, 477 bp, Homo sapiens; identical to SEQ ID NO: 542993
  misc_feature: HIJSMM301DYF3W.49.27.C05.1.454.light.4.raw

SEQ ID NO: 570384 - DNA, 509 bp, Homo sapiens
  misc_feature: HIJSMM301C2XJ9.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgattttactgctgctcatatgcaggtgatcacacttttatgttcgggactgggaccaaggtcaccgtcctaggtcagcccaaggccaaccccactgtcactctcg

SEQ ID NO: 570385 - DNA, 518 bp, Homo sapiens; identical to SEQ ID NO: 548899
  misc_feature: HIJSMM301AIKFO.41.25.C03.1.454.light.4.raw

SEQ ID NO: 570386 - DNA, 491 bp, Homo sapiens
  misc_feature: HIJSMM301EQGPN.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggacgaacggtggagatctaaacgaacta

SEQ ID NO: 570387 - DNA, 491 bp, Homo sapiens; identical to SEQ ID NO: 535294
  misc_feature: HIJSMM301B588V.16.68.G02.1.454.light.4.raw

SEQ ID NO: 570388 - DNA, 491 bp, Homo sapiens
  misc_feature: HIJSMM301C338M.27.78.H01.1.454.light.4.raw
agcgtcgtctcacgaccggtgctcgatttagtgtgagtagtttgggtttgggggcgatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcacttcggccaaggacacgactggagattaacgaactgtggctgcaccatctgtt

SEQ ID NO: 570389 - DNA, 460 bp, Homo sapiens; identical to SEQ ID NO: 540069
  misc_feature: HIJSMM301B0RN1.11.86.H09.1.454.light.4.raw

SEQ ID NO: 570390 - DNA, 507 bp, Homo sapiens; identical to SEQ ID NO: 538063
  misc_feature: HIJSMM301EOJNP.47.85.H08.1.454.light.4.raw

SEQ ID NO: 570391 - DNA, 511 bp, Homo sapiens; identical to SEQ ID NO: 546062
  misc_feature: HIJSMM301EAWPP.5.58.F03.1.454.light.4.raw

SEQ ID NO: 570392 - DNA, 488 bp, Homo sapiens; identical to SEQ ID NO: 561192
  misc_feature: HIJSMM301CD8UG.21.55.E11.1.454.light.4.raw

SEQ ID NO: 570393 - DNA, 497 bp, Homo sapiens; identical to SEQ ID NO: 534982
  misc_feature: HIJSMM301CH5AZ.26.80.H03.1.454.light.4.raw

SEQ ID NO: 570394 - DNA, 486 bp, Homo sapiens; identical to SEQ ID NO: 563765
  misc_feature: HIJSMM301BGACH.22.59.F04.1.454.light.4.raw

SEQ ID NO: 570395 - DNA, 495 bp, Homo sapiens
  misc_feature: HIJSMM301BY7I7.14.55.E11.1.454.light.4.raw
  modified_base (489)..(489): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacgaacggacggagatcagacgaactcgtggcgtgcaccactctcgtnttccta

SEQ ID NO: 570396 - DNA, 502 bp, Homo sapiens; identical to SEQ ID NO: 536253
  misc_feature: HIJSMM301DEAM1.21.22.B11.1.454.light.4.raw

SEQ ID NO: 570397 - DNA, 521 bp, Homo sapiens; identical to SEQ ID NO: 539470
  misc_feature: HIJSMM301CPNXS.27.23.C01.1.454.light.4.raw

SEQ ID NO: 570398 - DNA, 487 bp, Homo sapiens; identical to SEQ ID NO: 555321
  misc_feature: HIJSMM301EMWR2.19.71.G05.1.454.light.4.raw

SEQ ID NO: 570399 - DNA, 495 bp, Homo sapiens; identical to SEQ ID NO: 535486
  misc_feature: HIJSMM301DT22Y.26.72.G06.1.454.light.4.raw

SEQ ID NO: 570400 - DNA, 377 bp, Homo sapiens; identical to SEQ ID NO: 536071
  misc_feature: HIJSMM301BZVOV.40.9.A09.1.454.light.4.raw

SEQ ID NO: 570401 - DNA, 509 bp, Homo sapiens
  misc_feature: HIJSMM301BEZDJ.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggttttttggcggtcgggacccagatgactgtcctcagtcagcccaaggctgcccctcggt

SEQ ID NO: 570402 - DNA, 503 bp, Homo sapiens
  misc_feature: HIJSMM301EYAMI.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttagtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccg

SEQ ID NO: 570403 - DNA, 487 bp, Homo sapiens
  misc_feature: HIJSMM301BOZEH.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgtctccgtacacttttggccaggggaccaagttggagatcaaacgaa

SEQ ID NO: 570404 - DNA, 480 bp, Homo sapiens
  misc_feature: HIJSMM301A42W7.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccagcatcacctgctctggagataaattggggaataaatatgcttcctggtatcagcagaagccaggccagtcccctgtgctggccatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattcggcggagggaccaagctgaccgtccttggtcagaccccg

SEQ ID NO: 570405 - DNA, 489 bp, Homo sapiens; identical to SEQ ID NO: 535139
  misc_feature: HIJSMM301BQXDP.14.55.E11.1.454.light.4.raw

SEQ ID NO: 570406 - DNA, 489 bp, Homo sapiens; identical to SEQ ID NO: 544329
  misc_feature: HIJSMM301CS61E.11.28.C06.1.454.light.4.raw

SEQ ID NO: 570407 - DNA, 486 bp, Homo sapiens; identical to SEQ ID NO: 538754
  misc_feature: HIJSMM301B54P4.19.5.A05.1.454.light.4.raw

SEQ ID NO: 570408 - DNA, 493 bp, Homo sapiens; identical to SEQ ID NO: 539015
  misc_feature: HIJSMM301CUK78.27.78.H01.1.454.light.4.raw

SEQ ID NO: 570409 - DNA, 505 bp, Homo sapiens; identical to SEQ ID NO: 535503
  misc_feature: HIJSMM301EPIXF.8.28.C06.1.454.light.4.raw

SEQ ID NO: 570410 - DNA, 485 bp, Homo sapiens
  misc_feature: HIJSMM301CTW7N.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcacatct

SEQ ID NO: 570411 - DNA, 475 bp, Homo sapiens
  misc_feature: HIJSMM301AIVU4.13.39.D06.1.454.light.4.raw
tcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaacg

SEQ ID NO: 570412 - DNA, 494 bp, Homo sapiens; identical to SEQ ID NO: 534992
  misc_feature: HIJSMM301EVSFE.9.1.A01.1.454.light.4.raw

SEQ ID NO: 570413 - DNA, 421 bp, Homo sapiens
  misc_feature: HIJSMM301DPMBE.41.15.B04.1.454.light.4.raw
tctatactatcacgaccggtgctcgatttagacagtatatatccgcggcacgaccggtgctcgatttagtctagcgactttgggtttgggggaaagagccaccctctcctgcagggccagtgagacagttactgtcaattacttagcctggtaccagcagaagcctggctaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 570414 - DNA, 485 bp, Homo sapiens; identical to SEQ ID NO: 540394
  misc_feature: HIJSMM301BW0RH.46.26.C04.1.454.light.4.raw

SEQ ID NO: 570415 - DNA, 505 bp, Homo sapiens; identical to SEQ ID NO: 542067
  misc_feature: HIJSMM301BWNOI.8.1.A01.1.454.light.4.raw

SEQ ID NO: 570416 - DNA, 489 bp, Homo sapiens; identical to SEQ ID NO: 535776
  misc_feature: HIJSMM301CZJRZ.4.52.E08.1.454.light.4.raw

SEQ ID NO: 570417 - DNA, 515 bp, Homo sapiens
  misc_feature: HIJSMM301BLIKT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgtcgtccgaacggaccgaacggtaggaagtacaaacgaaacctaagtggcgtgcaccactactgtcttctatcgttcccc

SEQ ID NO: 570418 - DNA, 488 bp, Homo sapiens; identical to SEQ ID NO: 536861
  misc_feature: HIJSMM301BML74.12.88.H11.1.454.light.4.raw

SEQ ID NO: 570419 - DNA, 488 bp, Homo sapiens; identical to SEQ ID NO: 539612
  misc_feature: HIJSMM301BG2N6.3.55.E11.1.454.light.4.raw

SEQ ID NO: 570420 - DNA, 487 bp, Homo sapiens; identical to SEQ ID NO: 540841
  misc_feature: HIJSMM301BQ270.4.33.C11.1.454.light.4.raw

SEQ ID NO: 570421 - DNA, 496 bp, Homo sapiens; identical to SEQ ID NO: 535109
  misc_feature: HIJSMM301EBEQO.16.78.H01.1.454.light.4.raw

SEQ ID NO: 570422 - DNA, 487 bp, Homo sapiens; identical to SEQ ID NO: 537573
  misc_feature: HIJSMM301D7YHB.3.10.A10.1.454.light.4.raw

SEQ ID NO: 570423 - DNA, 483 bp, Homo sapiens
  misc_feature: HIJSMM301CXD81.51.64.F09.1.454.light.4.raw
cgatcgtatacacgaccggtgctcgatttagcgcgtatacaagggggaggaactggctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgctagtttattactgtcagcagtatgataagtggcctccgtacacttttggccagggaccaggctggagatcaaacgaactgtggctgcaccat

SEQ ID NO: 570424 - DNA, 502 bp, Homo sapiens
  misc_feature: HIJSMM301DBWRL.18.11.A11.1.454.light.4.raw
tacgagtatgcacgaccggtgctcgatttagctacgactgcagggggagctacaacaggcagacaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggctgcaccatctgtctt

SEQ ID NO: 570425 - DNA, 503 bp, Homo sapiens; identical to SEQ ID NO: 545379
  misc_feature: HIJSMM301C0A7S.9.53.E09.1.454.light.4.raw

SEQ ID NO: 570426 - DNA, 476 bp, Homo sapiens; identical to SEQ ID NO: 558127
  misc_feature: HIJSMM301CJQC9.14.5.A05.1.454.light.4.raw

SEQ ID NO: 570427 - DNA, 486 bp, Homo sapiens
  misc_feature: HIJSMM301DUKR8.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgactgtggctgcaccatctgt

SEQ ID NO: 570428 - DNA, 504 bp, Homo sapiens; identical to SEQ ID NO: 538940
  misc_feature: HIJSMM301CJFQJ.2.35.D02.1.454.light.4.raw

SEQ ID NO: 570429 - DNA, 505 bp, Homo sapiens; identical to SEQ ID NO: 535503
  misc_feature: HIJSMM301CDYTL.8.28.C06.1.454.light.4.raw

SEQ ID NO: 570430 - DNA, 509 bp, Homo sapiens; identical to SEQ ID NO: 535670
  misc_feature: HIJSMM301DQHC4.47.23.C01.1.454.light.4.raw

SEQ ID NO: 570431 - DNA, 471 bp, Homo sapiens; identical to SEQ ID NO: 537461
  misc_feature: HIJSMM301CZDQY.7.81.H04.1.454.light.4.raw

SEQ ID NO: 570432 - DNA, 483 bp, Homo sapiens
  misc_feature: HIJSMM301C6RQ7.48.83.H06.1.454.light.4.raw
agtatacatacacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 570433 - DNA, 508 bp, Homo sapiens
  misc_feature: HIJSMM301DLTLS.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaaggggaaagagcccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccgggggccactttcggccctgggaccaaggtggagatcaaacgaactgtggctgcaccatctgtcttca

SEQ ID NO: 570434 - DNA, 460 bp, Homo sapiens; identical to SEQ ID NO: 536053
  misc_feature: HIJSMM301EHR3C.22.28.C06.1.454.light.4.raw

SEQ ID NO: 570435 - DNA, 477 bp, Homo sapiens; identical to SEQ ID NO: 535122
  misc_feature: HIJSMM301DP3H5.26.72.G06.1.454.light.4.raw

SEQ ID NO: 570436 - DNA, 480 bp, Homo sapiens
  misc_feature: HIJSMM301B08N7.51.57.F02.1.454.light.4.raw
cgatcgtatacacgaccggtgctcgatttagctcgatatagttgggtttgggtgatgttgataccacgaaacatacttagaccccaaattatctccagagcaggtgatggtggctgtctgtcctggggacacggacactgagggtggctgagtcaggtcataggcggccagggatcctgtgcagtaagcaaggacgccgaggaagagagggatggtcagagtggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgttcccgccctcctctcgtagcact

SEQ ID NO: 570437 - DNA, 479 bp, Homo sapiens; identical to SEQ ID NO: 548655
  misc_feature: HIJSMM301CDWH1.48.5.A05.1.454.light.4.raw

SEQ ID NO: 570438 - DNA, 507 bp, Homo sapiens; identical to SEQ ID NO: 536874
  misc_feature: HIJSMM301D7TJO.17.41.D08.1.454.light.4.raw

SEQ ID NO: 570439 - DNA, 507 bp, Homo sapiens; identical to SEQ ID NO: 538702
  misc_feature: HIJSMM301CRF1X.11.57.F02.1.454.light.4.raw

SEQ ID NO: 570440 - DNA, 501 bp, Homo sapiens
  misc_feature: HIJSMM301C57AO.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttattactgtcagcaatattatattcctcctcagacgttcggccaaggaccaaggtaggaaatcaaacgaactgtggctgcaccta

SEQ ID NO: 570441 - DNA, 486 bp, Homo sapiens; identical to SEQ ID NO: 535043
  misc_feature: HIJSMM301CFF17.46.35.D02.1.454.light.4.raw

SEQ ID NO: 570442 - DNA, 509 bp, Homo sapiens
  misc_feature: HIJSMM301BTY46.51.57.F02.1.454.light.4.raw
cgatcgtatacacgaccggtgctcgatttagctcgatatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtca

SEQ ID NO: 570443 - DNA, 486 bp, Homo sapiens; identical to SEQ ID NO: 535458
  misc_feature: HIJSMM301DV63G.7.75.G09.1.454.light.4.raw

SEQ ID NO: 570444 - DNA, 489 bp, Homo sapiens
  misc_feature: HIJSMM301ESZW6.19.10.A10.1.454.light.4.raw
tactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcactccgtggtggacatttggccaggggaccaaggttgaagtcaaacgaactgtg

SEQ ID NO: 570445 - DNA, 494 bp, Homo sapiens
  misc_feature: HIJSMM301C33OC.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctggggatgatcttggtaacttattactgccaacaatataatagttattggtacgttcggtccgacgggaccgaaggtacgaaatagagacgaactagtggctgcaccat

SEQ ID NO: 570446 - DNA, 489 bp, Homo sapiens
  misc_feature: HIJSMM301CPDOX.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccgaaggtcgagatcaaacgaaactgtggctgcaccatctgtctt

SEQ ID NO: 570447 - DNA, 508 bp, Homo sapiens; identical to SEQ ID NO: 541908
  misc_feature: HIJSMM301CV3QJ.47.85.H08.1.454.light.4.raw

SEQ ID NO: 570448 - DNA, 484 bp, Homo sapiens; identical to SEQ ID NO: 535400
  misc_feature: HIJSMM301BUWHT.46.26.C04.1.454.light.4.raw

SEQ ID NO: 570449 - DNA, 522 bp, Homo sapiens; identical to SEQ ID NO: 538091
  misc_feature: HIJSMM301BD1BN.27.23.C01.1.454.light.4.raw

SEQ ID NO: 570450 - DNA, 512 bp, Homo sapiens; identical to SEQ ID NO: 541402
  misc_feature: HIJSMM301AIKPJ.43.19.B08.1.454.light.4.raw

SEQ ID NO: 570451 - DNA, 485 bp, Homo sapiens
  misc_feature: HIJSMM301CNF48.4.59.F04.1.454.light.4.raw
agcactgtagcacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttctaccatcagcagcctgcagcctgaagatactgcaacatattactgtcaacagtatgataatctgccgctcactttcggtcggagggaccgaacggtagggaggagtcaagaagaactagtggcgtcg

SEQ ID NO: 570452 - DNA, 505 bp, Homo sapiens; identical to SEQ ID NO: 536254
  misc_feature: HIJSMM301D7BLB.7.71.G05.1.454.light.4.raw

SEQ ID NO: 570453 - DNA, 454 bp, Homo sapiens; identical to SEQ ID NO: 535005
  misc_feature: HIJSMM301CNC19.19.86.H09.1.454.light.4.raw

SEQ ID NO: 570454 - DNA, 447 bp, Homo sapiens; identical to SEQ ID NO: 535201
  misc_feature: HIJSMM301AN9YT.18.9.A09.1.454.light.4.raw

SEQ ID NO: 570455 - DNA, 486 bp, Homo sapiens
  misc_feature: HIJSMM301DLWM8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcggagatcagacgaactgtggctgcaccatctgtcttc

SEQ ID NO: 570456 - DNA, 500 bp, Homo sapiens
  misc_feature: HIJSMM301BY892.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccc

SEQ ID NO: 570457 - DNA, 514 bp, Homo sapiens; identical to SEQ ID NO: 543870
  misc_feature: HIJSMM301EM3O9.40.12.B01.1.454.light.4.raw

SEQ ID NO: 570458 - DNA, 513 bp, Homo sapiens; identical to SEQ ID NO: 535244
  misc_feature: HIJSMM301C7PHE.17.33.C11.1.454.light.4.raw

SEQ ID NO: 570459 - DNA, 481 bp, Homo sapiens
  misc_feature: HIJSMM301DRSKQ.51.86.H09.1.454.light.4.raw
cgatcgtatacacgaccggtgctcgatttagtgctatagacttgggtttggggctttccctggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtaccctcagctcactttcggcggagggaccaaggtggagatcaaacgaactagtggctgcaccatctgtcttcactcttcccgccat

SEQ ID NO: 570460 - DNA, 505 bp, Homo sapiens
  misc_feature: HIJSMM301DABHB.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctggttcggcggagggaccaagctgaccgtcctaagtcagcccaaggctgccccctcggtcactctcg

SEQ ID NO: 570461 - DNA, 498 bp, Homo sapiens
  misc_feature: HIJSMM301AGK05.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggagatcaaacgaaactgtggctgcaccatctgtctt

SEQ ID NO: 570462 - DNA, 499 bp, Homo sapiens; identical to SEQ ID NO: 539403
  misc_feature: HIJSMM301DRJCU.48.59.F04.1.454.light.4.raw

SEQ ID NO: 570463 - DNA, 504 bp, Homo sapiens
  misc_feature: HIJSMM301AK73W.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgaccgtcctaggtcagccccaa

SEQ ID NO: 570464 - DNA, 482 bp, Homo sapiens; identical to SEQ ID NO: 535216
  misc_feature: HIJSMM301D9JBK.17.26.C04.1.454.light.4.raw

SEQ ID NO: 570465 - DNA, 443 bp, Homo sapiens; identical to SEQ ID NO: 544936
  misc_feature: HIJSMM301AN101.2.76.G10.1.454.light.4.raw

SEQ ID NO: 570466 - DNA, 479 bp, Homo sapiens; identical to SEQ ID NO: 542895
  misc_feature: HIJSMM301DGUCO.40.59.F04.1.454.light.4.raw

SEQ ID NO: 570467 - DNA, 520 bp, Homo sapiens; identical to SEQ ID NO: 539176
  misc_feature: HIJSMM301EOELD.27.23.C01.1.454.light.4.raw

SEQ ID NO: 570468 - DNA, 502 bp, Homo sapiens
  misc_feature: HIJSMM301BUDP7.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccgaagggaccgaacggtaggaaggtacaaacgaaactacgtggcgtgcaccatctgtctt

SEQ ID NO: 570469 - DNA, 507 bp, Homo sapiens; identical to SEQ ID NO: 544788
  misc_feature: HIJSMM301D2OGE.16.46.E02.1.454.light.4.raw

SEQ ID NO: 570470 - DNA, 489 bp, Homo sapiens; identical to SEQ ID NO: 562293
  misc_feature: HIJSMM301B2BMF.3.10.A10.1.454.light.4.raw

SEQ ID NO: 570471 - DNA, 521 bp, Homo sapiens
  misc_feature: HIJSMM301CR3I5.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacttcgtccgtcggaccgaacgtaggagtaatataacgaaacctaagtaggtcgtggcaccactactcgtcttt

SEQ ID NO: 570472 - DNA, 486 bp, Homo sapiens; identical to SEQ ID NO: 535043
  misc_feature: HIJSMM301APM3C.46.35.D02.1.454.light.4.raw

SEQ ID NO: 570473 - DNA, 514 bp, Homo sapiens
  misc_feature: HIJSMM301AMVI9.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtccactctgttcccg

SEQ ID NO: 570474 - DNA, 480 bp, Homo sapiens; identical to SEQ ID NO: 535291
  misc_feature: HIJSMM301CLGTU.22.59.F04.1.454.light.4.raw

SEQ ID NO: 570475 - DNA, 446 bp, Homo sapiens
  misc_feature: HIJSMM301CEE9I.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctcctactcgta

SEQ ID NO: 570476 - DNA, 486 bp, Homo sapiens
  misc_feature: HIJSMM301DSKNW.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtcctaggtcagcccaaggccaa

SEQ ID NO: 570477 - DNA, 444 bp, Homo sapiens; identical to SEQ ID NO: 536484
  misc_feature: HIJSMM301ESLDU.8.11.A11.1.454.light.4.raw

SEQ ID NO: 570478 - DNA, 506 bp, Homo sapiens
  misc_feature: HIJSMM301C2UAC.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactcttcg

SEQ ID NO: 570479 - DNA, 384 bp, Homo sapiens; identical to SEQ ID NO: 555393
  misc_feature: HIJSMM301ESPYI.48.87.H10.1.454.light.4.raw

SEQ ID NO: 570480 - DNA, 516 bp, Homo sapiens
  misc_feature: HIJSMM301DWXBL.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctcaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgccctcctacg

SEQ ID NO: 570481 - DNA, 518 bp, Homo sapiens
  misc_feature: HIJSMM301AY72B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggtagtttattactgtcaacagtttttctcgggcgttcggtccaagggacccgaaggtagggaaagtacaaaacgaaacctagtaggcgtgcgaccatctgtcttctatcttcccgt

SEQ ID NO: 570482 - DNA, 504 bp, Homo sapiens; identical to SEQ ID NO: 536385
  misc_feature: HIJSMM301C0R5E.27.78.H01.1.454.light.4.raw

SEQ ID NO: 570483 - DNA, 377 bp, Homo sapiens; identical to SEQ ID NO: 536071
  misc_feature: HIJSMM301BP5MR.40.9.A09.1.454.light.4.raw

SEQ ID NO: 570484 - DNA, 486 bp, Homo sapiens
  misc_feature: HIJSMM301AKU0F.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggataatcagacgaactgtgg

SEQ ID NO: 570485 - DNA, 511 bp, Homo sapiens; identical to SEQ ID NO: 550512
  misc_feature: HIJSMM301A5LDW.17.2.A02.1.454.light.4.raw

SEQ ID NO: 570486 - DNA, 490 bp, Homo sapiens
  misc_feature: HIJSMM301B5KSG.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggccccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccactgt

SEQ ID NO: 570487 - DNA, 520 bp, Homo sapiens
  misc_feature: HIJSMM301AV6UU.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagtattttgctagtttattactgtcaacatcgtaccgagtggccgtccgggggcctacgtttccggcccgtcgggaaccaaaattagagatacaaacgaactgtggctgcaccatctgtcttctatccttcccgccact

SEQ ID NO: 570488 - DNA, 511 bp, Homo sapiens
  misc_feature: HIJSMM301EN712.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttagggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 570489 - DNA, 493 bp, Homo sapiens; identical to SEQ ID NO: 549048
  misc_feature: HIJSMM301DOVZU.16.86.H09.1.454.light.4.raw

SEQ ID NO: 570490 - DNA, 486 bp, Homo sapiens; identical to SEQ ID NO: 536261
  misc_feature: HIJSMM301EOHRW.26.55.E11.1.454.light.4.raw

SEQ ID NO: 570491 - DNA, 417 bp, Homo sapiens
  misc_feature: HIJSMM301BV23Z.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttccccaccctcctcgagtagtaca

SEQ ID NO: 570492 - DNA, 513 bp, Homo sapiens; identical to SEQ ID NO: 564131
  misc_feature: HIJSMM301CLK3N.14.78.H01.1.454.light.4.raw

SEQ ID NO: 570493 - DNA, 513 bp, Homo sapiens
  misc_feature: HIJSMM301CFI21.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctcgttcccgccct

SEQ ID NO: 570494 - DNA, 384 bp, Homo sapiens
  misc_feature: HIJSMM301BLA9N.48.33.C11.1.454.light.4.raw
agtatacatacacgaccggtgctcgatttagagtgagctcgttggggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 570495 - DNA, 490 bp, Homo sapiens; identical to SEQ ID NO: 535234
  misc_feature: HIJSMM301BI9D4.17.21.B10.1.454.light.4.raw

SEQ ID NO: 570496 - DNA, 447 bp, Homo sapiens; identical to SEQ ID NO: 535201
  misc_feature: HIJSMM301DZDFZ.18.9.A09.1.454.light.4.raw

SEQ ID NO: 570497 - DNA, 481 bp, Homo sapiens
  misc_feature: HIJSMM301AZGGS.4.29.C07.1.454.light.4.raw
agcactgtagcacgaccggtgctcgatttagagtgctacgaagggaaagggggctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccgagggtggaaatcaaacgaactgtggctgcaccat

SEQ ID NO: 570498 - DNA, 492 bp, Homo sapiens
  misc_feature: HIJSMM301BC5AF.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaaatattatagtactcctccgaggctcactttcggcggagggaccaaggtggagatcaaacgaa

SEQ ID NO: 570499 - DNA, 500 bp, Homo sapiens
  misc_feature: HIJSMM301CET4X.14.23.C01.1.454.light.4.raw
cgtctagtaccacgaccggtgctcgatttagtacacgtgattagggattgggggaggaactgctcagttaggacccagacggaaccatggaagccccagcgcagcttctcttcatcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccgaaggtaggaaatacaaacgaactagtggctgcaccatctgtctt

SEQ ID NO: 570500 - DNA, 484 bp, Homo sapiens; identical to SEQ ID NO: 536162
  misc_feature: HIJSMM301A51NY.13.59.F04.1.454.light.4.raw

SEQ ID NO: 570501 - DNA, 514 bp, Homo sapiens
  misc_feature: HIJSMM301B269G.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcattctgttcccgccctcctcc

SEQ ID NO: 570502 - DNA, 367 bp, Homo sapiens; identical to SEQ ID NO: 557496
  misc_feature: HIJSMM301ANXBY.47.48.E04.1.454.light.4.raw

SEQ ID NO: 570503 - DNA, 494 bp, Homo sapiens; identical to SEQ ID NO: 535276
  misc_feature: HIJSMM301C0XL8.16.6.A06.1.454.light.4.raw

SEQ ID NO: 570504 - DNA, 503 bp, Homo sapiens
  misc_feature: HIJSMM301BSKS0.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaaagctctacaaactaccttacactttttggccaggggacccgaaaggctggagatacaaacgaaactgtggg

SEQ ID NO: 570505 - DNA, 490 bp, Homo sapiens; identical to SEQ ID NO: 537951
  misc_feature: HIJSMM301EC22F.19.57.F02.1.454.light.4.raw

SEQ ID NO: 570506 - DNA, 525 bp, Homo sapiens
  misc_feature: HIJSMM301CQL92.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaacggtccggacggtcgtaccgtccgtacgtacgtacgaccgaccggaccgacccccaaccctacgtcgtaccta

SEQ ID NO: 570507 - DNA, 502 bp, Homo sapiens
  misc_feature: HIJSMM301A2DFR.41.14.B03.1.454.light.4.raw
tctatactatcacgaccggtgctcgatttagtgtgagtagttccgcggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgcccccc

SEQ ID NO: 570508 - DNA, 483 bp, Homo sapiens
  misc_feature: HIJSMM301D8U6Z.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcaccctcctcgctacgtaga

SEQ ID NO: 570509 - DNA, 494 bp, Homo sapiens; identical to SEQ ID NO: 534992
  misc_feature: HIJSMM301D15L2.9.1.A01.1.454.light.4.raw

SEQ ID NO: 570510 - DNA, 486 bp, Homo sapiens; identical to SEQ ID NO: 535043
  misc_feature: HIJSMM301ASGLI.46.35.D02.1.454.light.4.raw

SEQ ID NO: 570511 - DNA, 488 bp, Homo sapiens; identical to SEQ ID NO: 537673
  misc_feature: HIJSMM301EA815.12.31.C09.1.454.light.4.raw

SEQ ID NO: 570512 - DNA, 489 bp, Homo sapiens; identical to SEQ ID NO: 536663
  misc_feature: HIJSMM301DXLA9.16.72.G06.1.454.light.4.raw

SEQ ID NO: 570513 - DNA, 520 bp, Homo sapiens; identical to SEQ ID NO: 539176
  misc_feature: HIJSMM301CRRUD.27.23.C01.1.454.light.4.raw

SEQ ID NO: 570514 - DNA, 485 bp, Homo sapiens
  misc_feature: HIJSMM301A46CP.49.83.H06.1.454.light.4.raw
agtcgagagacacgaccggtgctcgatttagatcacgtgcgtcgcgggggatcaggacttctcagttcatcttctcaccatgaggctccctgctcagctcctggggctgccaatgctctggaaacctgggtccagtgcggatattgtgatgacccagactccactctttctgtccgtcacccctggacagccggcctccatctcctgcaagtctagtcagaccctccagcatagtcttggcaagacctatttccatagtcacctgcacaagccaggccagcctccacaggtcctgatctatgatgtttccagccggttctctggagtggcggatgggttcagtggcagcgagtcagggccaggcttcacactgaaaatcagccgggtggaggctgaggatgttggggtttattattgcatgcagaggatagagatccctccgagacttttggccaggggaccgagctggagatcaaacgaactgt

SEQ ID NO: 570515 - DNA, 454 bp, Homo sapiens; identical to SEQ ID NO: 535005
  misc_feature: HIJSMM301ECYP9.19.86.H09.1.454.light.4.raw

SEQ ID NO: 570516 - DNA, 510 bp, Homo sapiens
  misc_feature: HIJSMM301AUA4C.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgccactc

SEQ ID NO: 570517 - DNA, 493 bp, Homo sapiens
  misc_feature: HIJSMM301C1BNV.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgtgttcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 570518 - DNA, 485 bp, Homo sapiens
  misc_feature: HIJSMM301AWL38.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagtacggtaccccgtacacttttggccagggaccaaactggacatcaaacgaactgtggctgcaccatctgt

SEQ ID NO: 570519 - DNA, 508 bp, Homo sapiens
  misc_feature: HIJSMM301CLIZR.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccagctgaccgtcctaggtcagcccaaggctgccccctcggtcactctgtt

SEQ ID NO: 570520 - DNA, 504 bp, Homo sapiens; identical to SEQ ID NO: 538423
  misc_feature: HIJSMM301DNPYF.48.67.G01.1.454.light.4.raw

SEQ ID NO: 570521 - DNA, 488 bp, Homo sapiens
  misc_feature: HIJSMM301BQRT8.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcccgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacc

SEQ ID NO: 570522 - DNA, 505 bp, Homo sapiens; identical to SEQ ID NO: 535987
  misc_feature: HIJSMM301DYJJM.18.37.D04.1.454.light.4.raw

SEQ ID NO: 570523 - DNA, 489 bp, Homo sapiens
  misc_feature: HIJSMM301AUWBZ.48.30.C08.1.454.light.4.raw
agtatacatacacgaccggtgctcgatttagtctgacgtcaaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 570524 - DNA, 503 bp, Homo sapiens; identical to SEQ ID NO: 538973
  misc_feature: HIJSMM301C3HQO.5.86.H09.1.454.light.4.raw

SEQ ID NO: 570525 - DNA, 489 bp, Homo sapiens
  misc_feature: HIJSMM301E1B97.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 570526 - DNA, 505 bp, Homo sapiens
  misc_feature: HIJSMM301AM8IZ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtgggcctcaaacgaactgtggctgcaccatctgtcttcatcttcccgcc

SEQ ID NO: 570527 - DNA, 487 bp, Homo sapiens; identical to SEQ ID NO: 536206
  misc_feature: HIJSMM301CPJLM.47.38.D05.1.454.light.4.raw

SEQ ID NO: 570528 - DNA, 512 bp, Homo sapiens
  misc_feature: HIJSMM301A55PV.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacgaggtatcggcggaggacctaagtcgaccgtctaggtcacgaccgaggctccgcccccgtcggcactctcgttcccaccctccg

SEQ ID NO: 570529 - DNA, 493 bp, Homo sapiens
  misc_feature: HIJSMM301CFGKJ.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggctttcggcggagggaccaagctgaccgtcctaggtcagcccaaggctgcccctcggtcactctgttcccaccctcctcgctacgtaga

SEQ ID NO: 570530 - DNA, 514 bp, Homo sapiens; identical to SEQ ID NO: 547648
  misc_feature: HIJSMM301BKR18.16.1.A01.1.454.light.4.raw

SEQ ID NO: 570531 - DNA, 491 bp, Homo sapiens
  misc_feature: HIJSMM301AN88B.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtgactttcggccaagggacaacggtggaatacagacgaactgtgg

SEQ ID NO: 570532 - DNA, 484 bp, Homo sapiens
  misc_feature: HIJSMM301AGL87.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgtcgggcgagtcacgacattaacacttatttagcctggtatcagcagaagccaggtagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 570533 - DNA, 501 bp, Homo sapiens
  misc_feature: HIJSMM301AF261.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagccaaggctgccccctcggtc

SEQ ID NO: 570534 - DNA, 518 bp, Homo sapiens
  misc_feature: HIJSMM301BYP1I.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggcctgccccctggtcactctgttcccaccctcctcacg

SEQ ID NO: 570535 - DNA, 505 bp, Homo sapiens
  misc_feature: HIJSMM301D4E6T.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaaggctgaccgtcctaggtcagcccaaggctgccccctcggtcta

SEQ ID NO: 570536 - DNA, 498 bp, Homo sapiens
  misc_feature: HIJSMM301BK5RA.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggtagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgca

SEQ ID NO: 570537 - DNA, 481 bp, Homo sapiens
  misc_feature: HIJSMM301BYHUO.4.34.D01.1.454.light.4.raw
agcactgtagcacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagccc

SEQ ID NO: 570538 - DNA, 510 bp, Homo sapiens
  misc_feature: HIJSMM301C2JQ4.17.2.A02.1.454.light.4.raw
  modified_base (506)..(506): a, c, t, g, unknown or other
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggcccaacccactgtcactctgttcccnccct

SEQ ID NO: 570539 - DNA, 495 bp, Homo sapiens; identical to SEQ ID NO: 536020
  misc_feature: HIJSMM301C8HV7.41.38.D05.1.454.light.4.raw

SEQ ID NO: 570540 - DNA, 497 bp, Homo sapiens
  misc_feature: HIJSMM301A655P.48.30.C08.1.454.light.4.raw
agtatacatacacgaccggtgctcgatttagtctgacgtcaaagggaaggggggaactgctcagttaggacccagacggaaccatggaagccccagcgcagcttctcttcctcctgctactctggctcccagatgtcactggaagaaaaataatgacgcagtctccagcccccctgcctgtgtctccaggggaaagagccaccctctcctgcagggccagtcagagtattagcagtgacttaaccttctacaaccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccaagggaccgaaggtggaaatacaaacgaactgtggctgcaccatctgtcttcatcttcccgccat

SEQ ID NO: 570541 - DNA, 474 bp, Homo sapiens
  misc_feature: HIJSMM301DLLMA.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccgaaggaccgaaggtgggaaatacaaacgaactagt

SEQ ID NO: 570542 - DNA, 484 bp, Homo sapiens; identical to SEQ ID NO: 540581
  misc_feature: HIJSMM301CNQV6.3.88.H11.1.454.light.4.raw

SEQ ID NO: 570543 - DNA, 504 bp, Homo sapiens; identical to SEQ ID NO: 539083
  misc_feature: HIJSMM301DTVTG.8.19.B08.1.454.light.4.raw

SEQ ID NO: 570544 - DNA, 507 bp, Homo sapiens
  misc_feature: HIJSMM301ALN1B.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggccctgggaccaaagtggagtatcaaacgaactgtggctgcaccatctgtctt

SEQ ID NO: 570545 - DNA, 493 bp, Homo sapiens; identical to SEQ ID NO: 537281
  misc_feature: HIJSMM301DSUJX.9.1.A01.1.454.light.4.raw

SEQ ID NO: 570546 - DNA, 502 bp, Homo sapiens
  misc_feature: HIJSMM301CJF8X.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 570547 - DNA, 516 bp, Homo sapiens
  misc_feature: HIJSMM301DJIXT.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctcgccccctcggtcactctcgttccccaccct

SEQ ID NO: 570548 - DNA, 503 bp, Homo sapiens
  misc_feature: HIJSMM301BFVSV.10.71.G05.1.454.light.4.raw
  modified_base (493)..(493): a, c, t, g, unknown or other
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaataagaggtacaacgaactgtggctgcaccatcngttcttcatt

SEQ ID NO: 570549 - DNA, 488 bp, Homo sapiens; identical to SEQ ID NO: 542699
  misc_feature: HIJSMM301AQ9FP.12.51.E07.1.454.light.4.raw

SEQ ID NO: 570550 - DNA, 520 bp, Homo sapiens; identical to SEQ ID NO: 535773
  misc_feature: HIJSMM301CESPI.41.19.B08.1.454.light.4.raw

SEQ ID NO: 570551 - DNA, 483 bp, Homo sapiens; identical to SEQ ID NO: 535413
  misc_feature: HIJSMM301AF7GR.26.78.H01.1.454.light.4.raw

SEQ ID NO: 570552 - DNA, 492 bp, Homo sapiens
  misc_feature: HIJSMM301AX8U0.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagcccc

SEQ ID NO: 570553 - DNA, 504 bp, Homo sapiens
  misc_feature: HIJSMM301CYRG8.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaatgggaccaaggtcaccgtctaggtcagcccaaggccaacccactgtcact

SEQ ID NO: 570554 - DNA, 447 bp, Homo sapiens; identical to SEQ ID NO: 535020
  misc_feature: HIJSMM301BPNXU.18.9.A09.1.454.light.4.raw

SEQ ID NO: 570555 - DNA, 477 bp, Homo sapiens
  misc_feature: HIJSMM301BWC2Z.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggagatcaagcgaactggtggctagca

SEQ ID NO: 570556 - DNA, 494 bp, Homo sapiens; identical to SEQ ID NO: 534992
  misc_feature: HIJSMM301A6LZX.9.1.A01.1.454.light.4.raw

SEQ ID NO: 570557 - DNA, 492 bp, Homo sapiens; identical to SEQ ID NO: 537666
  misc_feature: HIJSMM301BUGSO.43.33.C11.1.454.light.4.raw

SEQ ID NO: 570558 - DNA, 487 bp, Homo sapiens
  misc_feature: HIJSMM301CAXJ3.3.82.H05.1.454.light.4.raw
  modified_base (378)..(378): a, c, t, g, unknown or other
  modified_base (422)..(422): a, c, t, g, unknown or other
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagccctgagttcctgatgtctgctgcatccaccctgcaaagtggagtcccatccagattcagcgtcagtgaatctgggacagagttcactctcaccatcagcagcccgnacgctcgagtaatttgtacacttaacttattgttcaacagcgtnagacgtctccgcctctacttcggtcggagggaccgaacggtagggagagtacaaacgaactagtt

SEQ ID NO: 570559 - DNA, 495 bp, Homo sapiens; identical to SEQ ID NO: 535596
  misc_feature: HIJSMM301CV5RE.10.79.H02.1.454.light.4.raw

SEQ ID NO: 570560 - DNA, 514 bp, Homo sapiens; identical to SEQ ID NO: 545978
  misc_feature: HIJSMM301AY5RL.17.33.C11.1.454.light.4.raw

SEQ ID NO: 570561 - DNA, 477 bp, Homo sapiens; identical to SEQ ID NO: 535122
  misc_feature: HIJSMM301CXIP9.26.72.G06.1.454.light.4.raw

SEQ ID NO: 570562 - DNA, 506 bp, Homo sapiens; identical to SEQ ID NO: 536355
  misc_feature: HIJSMM301DLIP5.47.85.H08.1.454.light.4.raw

SEQ ID NO: 570563 - DNA, 489 bp, Homo sapiens; identical to SEQ ID NO: 535139
  misc_feature: HIJSMM301BO1SX.14.55.E11.1.454.light.4.raw

SEQ ID NO: 570564 - DNA, 496 bp, Homo sapiens; identical to SEQ ID NO: 544846
  misc_feature: HIJSMM301EORWT.12.37.D04.1.454.light.4.raw

SEQ ID NO: 570565 - DNA, 499 bp, Homo sapiens
  misc_feature: HIJSMM301DQN91.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagattttgcgacttactattgtcaacaggggtacagttttccgtactacctttggccaggggactaagctggacatcaaacgaactgtggctgcaccatctgtcttcatcttccccg

SEQ ID NO: 570566 - DNA, 503 bp, Homo sapiens; identical to SEQ ID NO: 557698
  misc_feature: HIJSMM301EWYEK.4.39.D06.1.454.light.4.raw

SEQ ID NO: 570567 - DNA, 447 bp, Homo sapiens; identical to SEQ ID NO: 535020
  misc_feature: HIJSMM301BLZFF.18.9.A09.1.454.light.4.raw

SEQ ID NO: 570568 - DNA, 513 bp, Homo sapiens; identical to SEQ ID NO: 543780
  misc_feature: HIJSMM301C6AG3.17.33.C11.1.454.light.4.raw

SEQ ID NO: 570569 - DNA, 494 bp, Homo sapiens; identical to SEQ ID NO: 534994
  misc_feature: HIJSMM301EUJSE.27.78.H01.1.454.light.4.raw

SEQ ID NO: 570570 - DNA, 444 bp, Homo sapiens; identical to SEQ ID NO: 534993
  misc_feature: HIJSMM301C8CK1.5.9.A09.1.454.light.4.raw

SEQ ID NO: 570571 - DNA, 521 bp, Homo sapiens
  misc_feature: HIJSMM301EX9Y3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctcgccccctcggtcactctgttcccaccct

SEQ ID NO: 570572 - DNA, 515 bp, Homo sapiens
  misc_feature: HIJSMM301CNI7M.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccca

SEQ ID NO: 570573 - DNA, 513 bp, Homo sapiens; identical to SEQ ID NO: 562672
  misc_feature: HIJSMM301B6LIQ.40.12.B01.1.454.light.4.raw

SEQ ID NO: 570574 - DNA, 495 bp, Homo sapiens; identical to SEQ ID NO: 555992
  misc_feature: HIJSMM301DIOJK.3.33.C11.1.454.light.4.raw

SEQ ID NO: 570575 - DNA, 499 bp, Homo sapiens
  misc_feature: HIJSMM301EFD6F.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgaggggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 570576 - DNA, 493 bp, Homo sapiens; identical to SEQ ID NO: 540903
  misc_feature: HIJSMM301CERS7.10.20.B09.1.454.light.4.raw

SEQ ID NO: 570577 - DNA, 516 bp, Homo sapiens; identical to SEQ ID NO: 543914
  misc_feature: HIJSMM301DTT2S.5.27.C05.1.454.light.4.raw

SEQ ID NO: 570578 - DNA, 444 bp, Homo sapiens; identical to SEQ ID NO: 535192
  misc_feature: HIJSMM301CLLXT.5.9.A09.1.454.light.4.raw

SEQ ID NO: 570579 - DNA, 517 bp, Homo sapiens
  misc_feature: HIJSMM301B68EC.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttcccc

SEQ ID NO: 570580 - DNA, 482 bp, Homo sapiens
  misc_feature: HIJSMM301DLJCW.49.73.G07.1.454.light.4.raw
agtcgagagacacgaccggtgctcgatttagctctacgctcagggcacgaccggtgctcgatttagctctacgctcagggcacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctacgatgcatccaatttggaaataggggtcccatcaaggttcagtggaagtggatctgggacgtatttactttcaccatcatcaacctgcagcctgaggatattgcaacatattaactgtcaacaata

SEQ ID NO: 570581 - DNA, 495 bp, Homo sapiens; identical to SEQ ID NO: 554198
  misc_feature: HIJSMM301C8M9U.41.53.E09.1.454.light.4.raw

SEQ ID NO: 570582 - DNA, 489 bp, Homo sapiens
  misc_feature: HIJSMM301ENUDC.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcacggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcga

SEQ ID NO: 570583 - DNA, 494 bp, Homo sapiens; identical to SEQ ID NO: 545186
  misc_feature: HIJSMM301C47N5.7.59.F04.1.454.light.4.raw

SEQ ID NO: 570584 - DNA, 500 bp, Homo sapiens
  misc_feature: HIJSMM301EFEV9.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcgg

SEQ ID NO: 570585 - DNA, 464 bp, Homo sapiens; identical to SEQ ID NO: 536640
  misc_feature: HIJSMM301DOEVW.26.78.H01.1.454.light.4.raw

SEQ ID NO: 570586 - DNA, 497 bp, Homo sapiens
  misc_feature: HIJSMM301AGK1D.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccaggggaccgaacggtggaaggtacaagacgaacgtagtggctgcaccaatctgt

SEQ ID NO: 570587 - DNA, 481 bp, Homo sapiens; identical to SEQ ID NO: 535993
  misc_feature: HIJSMM301BRF5Q.21.25.C03.1.454.light.4.raw

SEQ ID NO: 570588 - DNA, 496 bp, Homo sapiens
  misc_feature: HIJSMM301AJGL0.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagttcgctctcgaagtgttcggcggagggaccgagctgaccgtcctacgtcagccaaggctcg

SEQ ID NO: 570589 - DNA, 487 bp, Homo sapiens; identical to SEQ ID NO: 537573
  misc_feature: HIJSMM301BNS27.3.10.A10.1.454.light.4.raw

SEQ ID NO: 570590 - DNA, 504 bp, Homo sapiens
  misc_feature: HIJSMM301BGZEO.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtca

SEQ ID NO: 570591 - DNA, 514 bp, Homo sapiens
  misc_feature: HIJSMM301D6EKZ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaaagctgaccgtcctaggtcagcccaaggctgccccctcggtcactctgttccccaccctcctccgctacgt

SEQ ID NO: 570592 - DNA, 485 bp, Homo sapiens; identical to SEQ ID NO: 535880
  misc_feature: HIJSMM301C1EDL.7.75.G09.1.454.light.4.raw

SEQ ID NO: 570593 - DNA, 506 bp, Homo sapiens
  misc_feature: HIJSMM301B63JI.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcacttttcggcggagggaccaaggtggacctcaaacgaactgtggctgcaccatctgtcttcatcttcccgcc

SEQ ID NO: 570594 - DNA, 447 bp, Homo sapiens; identical to SEQ ID NO: 535882
  misc_feature: HIJSMM301AQZL9.18.9.A09.1.454.light.4.raw
  modified_base (429)..(429): a, c, t, g, unknown or other

SEQ ID NO: 570595 - DNA, 529 bp, Homo sapiens
  misc_feature: HIJSMM301DE3L1.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtctagttgtaccgtccgtggtcgagcccaacggcgtcgccccctccggtcactctcgttcccgtccctccctccacta

SEQ ID NO: 570596 - DNA, 487 bp, Homo sapiens
  misc_feature: HIJSMM301DJJG5.43.33.C11.1.454.light.4.raw
  modified_base (364)..(364): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttcnctcgtcatcactggtctacagtctgacgacggcgcaatgtacttctgtcaacactatgcctctcccccctacaatttcggtcagggaccaagttgaacatcaatcgaactgtggctgcaccat

SEQ ID NO: 570597 - DNA, 483 bp, Homo sapiens; identical to SEQ ID NO: 544786
  misc_feature: HIJSMM301EC9W4.46.26.C04.1.454.light.4.raw

SEQ ID NO: 570598 - DNA, 499 bp, Homo sapiens
  misc_feature: HIJSMM301BLPH3.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcattaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgcatctgacata

SEQ ID NO: 570599 - DNA, 502 bp, Homo sapiens; identical to SEQ ID NO: 541971
  misc_feature: HIJSMM301ETLH9.4.39.D06.1.454.light.4.raw

SEQ ID NO: 570600 - DNA, 485 bp, Homo sapiens; identical to SEQ ID NO: 536576
  misc_feature: HIJSMM301BHUM8.46.35.D02.1.454.light.4.raw

SEQ ID NO: 570601 - DNA, 504 bp, Homo sapiens; identical to SEQ ID NO: 567466
  misc_feature: HIJSMM301EO40J.10.82.H05.1.454.light.4.raw

SEQ ID NO: 570602 - DNA, 496 bp, Homo sapiens
  misc_feature: HIJSMM301BDC1M.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggagtcagggggtcttcggcggagggacgaagctgaccgtcctgagtcagcccaaggctgccccctcggtcactctgtt

SEQ ID NO: 570603 - DNA, 498 bp, Homo sapiens
  misc_feature: HIJSMM301CG7UC.51.9.A09.1.454.light.4.raw
cgatcgtatacacgaccggtgctcgatttagcgagacgcgcaggggccactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgtatttggcacagcagcgcttgggtattcgggcggggggaccaaactgaccgtcctaggtcagcccaaggctccg

SEQ ID NO: 570604 - DNA, 491 bp, Homo sapiens
  misc_feature: HIJSMM301CC0CR.21.9.A09.1.454.light.4.raw
  modified_base (483)..(483): a, c, t, g, unknown or other
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcctgatgattttgcaacttattactgccaacattacaatgattactcgcgtacgttcggccaagggaccagggtggaaatcaaacgaactgtggctgcaccatcngtcttcta

SEQ ID NO: 570605 - DNA, 494 bp, Homo sapiens; identical to SEQ ID NO: 534994
  misc_feature: HIJSMM301A1X1M.27.78.H01.1.454.light.4.raw

SEQ ID NO: 570606 - DNA, 421 bp, Homo sapiens
  misc_feature: HIJSMM301BWT0D.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactttgttcccgccctcctcagacgtatca

SEQ ID NO: 570607 - DNA, 486 bp, Homo sapiens; identical to SEQ ID NO: 540588
  misc_feature: HIJSMM301ED8UW.49.81.H04.1.454.light.4.raw

SEQ ID NO: 570608 - DNA, 444 bp, Homo sapiens
  misc_feature: HIJSMM301AN135.18.73.G07.1.454.light.4.raw
  modified_base (426)..(426): a, c, t, g, unknown or other
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgcagctcatatacaagcaccagcactctctatgtcttcggaactgggaccaaggtcaccgtcctaggtcagcccaaggccaaccccactgtcactctgttcccnccctcctccatactcgta

SEQ ID NO: 570609 - DNA, 496 bp, Homo sapiens
  misc_feature: HIJSMM301DGPL6.41.45.E01.1.454.light.4.raw
tctatactatcacgaccggtgctcgatttagtgagtcagtaaggaaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtctaggtcagccaaggctgcccctcggtcact

SEQ ID NO: 570610 - DNA, 503 bp, Homo sapiens
  misc_feature: HIJSMM301C0VK2.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacgttataactatgtctcctggtaccaacaacacccaggcaaagcccccaaaattcataatttatgaggtcactaagcggccctcaggggtccctgatcgcttctctgcctccaaggctggcaacacggcctccctgaccgtctctgggctccaggctgaggatgaggctgattatattgcagctcatatgcaggcagttacaatgtgatattcggcggagggaccaaactgaccgtcctaggtcagcccaaggctgcccctcc

SEQ ID NO: 570611 - DNA, 487 bp, Homo sapiens; identical to SEQ ID NO: 535583
  misc_feature: HIJSMM301CUP26.22.73.G07.1.454.light.4.raw

SEQ ID NO: 570612 - DNA, 483 bp, Homo sapiens
  misc_feature: HIJSMM301BNX1D.52.5.A05.1.454.light.4.raw
cgcagtacgacacgaccggtgctcgatttagatagatagacagggggggcctcaggaagcagcatcggaggtgcctcagccatggcatggatccctctcttcctcggcgtccttgcttactgcacaggttctgtggcctcctatgacttgactcagccaccctcagtgtccgtgcccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggccaagctgaccgtcctacgtcagcccaaggctgccccctcggtca

SEQ ID NO: 570613 - DNA, 503 bp, Homo sapiens; identical to SEQ ID NO: 562291
  misc_feature: HIJSMM301BMXWI.9.71.G05.1.454.light.4.raw

SEQ ID NO: 570614 - DNA, 500 bp, Homo sapiens
  misc_feature: HIJSMM301ADKNY.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctccaggagtccctcgatcgattctctggctccaagtctggcaacacggcctccctgaacatctctgggctccaggctgaggatgaggctgattattattgctgctcatatggaagtacctactcttttcttcttcggaactgggaccacggtcaccgtcctaggtcacgcccaaggccaacccca

SEQ ID NO: 570615 - DNA, 491 bp, Homo sapiens
  misc_feature: HIJSMM301DB14W.48.78.H01.1.454.light.4.raw
agtatacatacacgaccggtgctcgatttagtgtgagtagtttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 570616 - DNA, 486 bp, Homo sapiens; identical to SEQ ID NO: 536555
  misc_feature: HIJSMM301B9KC7.26.23.C01.1.454.light.4.raw

SEQ ID NO: 570617 - DNA, 498 bp, Homo sapiens
  misc_feature: HIJSMM301C49YV.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcagcagcactcaggttttcggtcggagggaccaagctgaccgtcctaggtcagcccaaggctgccccctcggt

SEQ ID NO: 570618 - DNA, 487 bp, Homo sapiens; identical to SEQ ID NO: 536025
  misc_feature: HIJSMM301B2E67.17.34.D01.1.454.light.4.raw

SEQ ID NO: 570619 - DNA, 510 bp, Homo sapiens
  misc_feature: HIJSMM301EZ1PS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctctactttcggcggagggaccgaaggtggagatacaaacgaactagtggctgcaccatctgtt

SEQ ID NO: 570620 - DNA, 526 bp, Homo sapiens
  misc_feature: HIJSMM301AQI4C.16.59.F04.1.454.light.4.raw
tgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggttagggaccaagctgaccgtcctaggtcagcccaaggctgccccctccggtcactctgttcccaccctcccgactagtaca

SEQ ID NO: 570621 - DNA, 485 bp, Homo sapiens; identical to SEQ ID NO: 535606
  misc_feature: HIJSMM301BLCNA.47.46.E02.1.454.light.4.raw

SEQ ID NO: 570622 - DNA, 499 bp, Homo sapiens
  misc_feature: HIJSMM301AG3UV.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtca

SEQ ID NO: 570623 - DNA, 502 bp, Homo sapiens; identical to SEQ ID NO: 544444
  misc_feature: HIJSMM301DYLYJ.5.24.C02.1.454.light.4.raw

SEQ ID NO: 570624 - DNA, 441 bp, Homo sapiens; identical to SEQ ID NO: 550529
  misc_feature: HIJSMM301D09OE.41.9.A09.1.454.light.4.raw

SEQ ID NO: 570625 - DNA, 477 bp, Homo sapiens; identical to SEQ ID NO: 537678
  misc_feature: HIJSMM301D4XOK.12.1.A01.1.454.light.4.raw

SEQ ID NO: 570626 - DNA, 491 bp, Homo sapiens
  misc_feature: HIJSMM301CLG2C.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggaattttgcaacttactactgtcaacagagttacaggcccccctatacttttggccaggggaccaagctggagatcacaggaactgtggctgcaccattc

SEQ ID NO: 570627 - DNA, 492 bp, Homo sapiens; identical to SEQ ID NO: 540973
  misc_feature: HIJSMM301DV2N1.43.20.B09.1.454.light.4.raw

SEQ ID NO: 570628 - DNA, 487 bp, Homo sapiens; identical to SEQ ID NO: 538190
  misc_feature: HIJSMM301B7SM3.47.70.G04.1.454.light.4.raw

SEQ ID NO: 570629 - DNA, 478 bp, Homo sapiens
  misc_feature: HIJSMM301C8MNT.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtca

SEQ ID NO: 570630 - DNA, 496 bp, Homo sapiens; identical to SEQ ID NO: 535109
  misc_feature: HIJSMM301C5MXH.16.78.H01.1.454.light.4.raw

SEQ ID NO: 570631 - DNA, 518 bp, Homo sapiens; identical to SEQ ID NO: 539372
  misc_feature: HIJSMM301DP1L4.7.86.H09.1.454.light.4.raw

SEQ ID NO: 570632 - DNA, 522 bp, Homo sapiens
  misc_feature: HIJSMM301A8K86.10.75.G09.1.454.light.4.raw
catagtagtgcacgaccggtgctcgatttagtatagacatcaggggggggtcgtcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcgggagggaccaaactcgaccgtccttcgtcacgcccgaaggctcgcccccgtccggtcactcttcgtcccccta

SEQ ID NO: 570633 - DNA, 504 bp, Homo sapiens
  misc_feature: HIJSMM301C412N.52.34.D01.1.454.light.4.raw
cgcagtacgacacgaccggtgctcgatttagatcgtctgtgttgggtttgggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgagattttgcagtttattactgttcagcagcgtagcaactggcctccgatcaccttcggccaagggacacgactggagattaaacgaactgtggctgcaccatctgtcttcatcttccccg

SEQ ID NO: 570634 - DNA, 521 bp, Homo sapiens
  misc_feature: HIJSMM301BEGMW.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctccctccgtcgt

SEQ ID NO: 570635 - DNA, 479 bp, Homo sapiens; identical to SEQ ID NO: 545213
  misc_feature: HIJSMM301D4D9C.40.59.F04.1.454.light.4.raw

SEQ ID NO: 570636 - DNA, 480 bp, Homo sapiens
  misc_feature: HIJSMM301AJS9C.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 570637 - DNA, 512 bp, Homo sapiens; identical to SEQ ID NO: 548157
  misc_feature: HIJSMM301CZ5CQ.17.33.C11.1.454.light.4.raw

SEQ ID NO: 570638 - DNA, 489 bp, Homo sapiens
  misc_feature: HIJSMM301AHDNT.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccaatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgt

SEQ ID NO: 570639 - DNA, 497 bp, Homo sapiens; identical to SEQ ID NO: 536371
  misc_feature: HIJSMM301BZ30B.16.78.H01.1.454.light.4.raw

SEQ ID NO: 570640 - DNA, 469 bp, Homo sapiens; identical to SEQ ID NO: 545689
  misc_feature: HIJSMM301CIN1M.13.76.G10.1.454.light.4.raw

SEQ ID NO: 570641 - DNA, 486 bp, Homo sapiens; identical to SEQ ID NO: 535043
  misc_feature: HIJSMM301EZLYU.46.35.D02.1.454.light.4.raw

SEQ ID NO: 570642 - DNA, 481 bp, Homo sapiens
  misc_feature: HIJSMM301BRW3Y.7.76.G10.1.454.light.4.raw
cgtgtctctacacgaccggtgctcgatttagtcactcatacgagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgcaacttactattgtcaacaggctaacagtttcccgctcaccttcgggcggggggaccaaggtggagatacaaacgaactgtggctgcacc

SEQ ID NO: 570643 - DNA, 441 bp, Homo sapiens; identical to SEQ ID NO: 534971
  misc_feature: HIJSMM301CUYJ7.11.3.A03.1.454.light.4.raw

SEQ ID NO: 570644 - DNA, 524 bp, Homo sapiens
  misc_feature: HIJSMM301DS5CH.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatatgcttgttggtaccagaagaagtcaggccaggccccggtgttgctcatctatgacgacagaaaacgaccctccgggatccctgagagattctctggctccaacctcagggaccatggccacgttgactatcagcggggcccaggtggaggatgaaggtgactactattgttactcaccagacaccagtgaaaaatcacaagaggaataattcggcggagggaccaagctgaccgtcctaggtcagcccaaggctgccccctcggtcactctgttcccgccctcctct

SEQ ID NO: 570645 - DNA, 503 bp, Homo sapiens
  misc_feature: HIJSMM301EHVCN.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtccaggtccaggcccaa

SEQ ID NO: 570646 - DNA, 477 bp, Homo sapiens; identical to SEQ ID NO: 535122
  misc_feature: HIJSMM301CGM3E.26.72.G06.1.454.light.4.raw

SEQ ID NO: 570647 - DNA, 514 bp, Homo sapiens; identical to SEQ ID NO: 538153
  misc_feature: HIJSMM301B32L2.17.37.D04.1.454.light.4.raw

SEQ ID NO: 570648 - DNA, 491 bp, Homo sapiens; identical to SEQ ID NO: 535176
  misc_feature: HIJSMM301A76HD.13.39.D06.1.454.light.4.raw

SEQ ID NO: 570649 - DNA, 494 bp, Homo sapiens
  misc_feature: HIJSMM301AK626.40.38.D05.1.454.light.4.raw
tctagcgactcacgaccggtgctcgatttagtatctgatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaa

SEQ ID NO: 570650 - DNA, 489 bp, Homo sapiens; identical to SEQ ID NO: 535139
  misc_feature: HIJSMM301AK0YQ.14.55.E11.1.454.light.4.raw

SEQ ID NO: 570651 - DNA, 487 bp, Homo sapiens
  misc_feature: HIJSMM301C6DR1.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctccgg

SEQ ID NO: 570652 - DNA, 486 bp, Homo sapiens; identical to SEQ ID NO: 535385
  misc_feature: HIJSMM301CWBSQ.19.71.G05.1.454.light.4.raw

SEQ ID NO: 570653 - DNA, 483 bp, Homo sapiens
  misc_feature: HIJSMM301DIEC1.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcaggaccgacggtcggagtgtcaagcgaacgtagtggctgcacact

SEQ ID NO: 570654 - DNA, 492 bp, Homo sapiens
  misc_feature: HIJSMM301EVRXE.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcgccacgggacgaacggtaggaagtacaaacgaaactagtggcgtgcacca

SEQ ID NO: 570655 - DNA, 494 bp, Homo sapiens
  misc_feature: HIJSMM301AMKBE.49.86.H09.1.454.light.4.raw
agtcgagagacacgaccggtgctcgatttagtgctatagacttgggtttggggactgctcagttaggacccagagggaaccatggaagccccagctcagtttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtctt

SEQ ID NO: 570656 - DNA, 500 bp, Homo sapiens
  misc_feature: HIJSMM301EUR3N.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccaagggaccgaacggtaggaaagtacaacgaactacgtggctgcgaccatctgttc

SEQ ID NO: 570657 - DNA, 504 bp, Homo sapiens
  misc_feature: HIJSMM301DAWMJ.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccc

SEQ ID NO: 570658 - DNA, 476 bp, Homo sapiens
  misc_feature: HIJSMM301AHE1O.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccgaaggtggagatcaaacgaact

SEQ ID NO: 570659 - DNA, 386 bp, Homo sapiens
  misc_feature: HIJSMM301B4P23.41.25.C03.1.454.light.4.raw
tctatactatcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggtcggagggaccgaaggtggagatcaaacgaaactgtggctgcaccatctgtcttcatcttcccgccatctgaatagtataga

SEQ ID NO: 570660 - DNA, 390 bp, Homo sapiens
  misc_feature: HIJSMM301DKI53.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccgaccctcctccgagcgacga

SEQ ID NO: 570661 - DNA, 492 bp, Homo sapiens
  misc_feature: HIJSMM301B1O7L.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcggcccagggaccacagtggatatcaggcgaactgtggctgcaccatctgtctt

SEQ ID NO: 570662 - DNA, 478 bp, Homo sapiens; identical to SEQ ID NO: 543315
  misc_feature: HIJSMM301EY2DU.26.72.G06.1.454.light.4.raw

SEQ ID NO: 570663 - DNA, 489 bp, Homo sapiens; identical to SEQ ID NO: 540655
  misc_feature: HIJSMM301B8NAM.22.87.H10.1.454.light.4.raw

SEQ ID NO: 570664 - DNA, 487 bp, Homo sapiens; identical to SEQ ID NO: 536179
  misc_feature: HIJSMM301EWB8P.19.57.F02.1.454.light.4.raw

SEQ ID NO: 570665 - DNA, 444 bp, Homo sapiens; identical to SEQ ID NO: 535192
  misc_feature: HIJSMM301DEXYH.5.9.A09.1.454.light.4.raw

SEQ ID NO: 570666 - DNA, 495 bp, Homo sapiens; identical to SEQ ID NO: 555261
  misc_feature: HIJSMM301DR3LK.51.71.G05.1.454.light.4.raw

SEQ ID NO: 570667 - DNA, 480 bp, Homo sapiens; identical to SEQ ID NO: 535442
  misc_feature: HIJSMM301B6VFR.41.17.B06.1.454.light.4.raw

SEQ ID NO: 570668 - DNA, 495 bp, Homo sapiens
  misc_feature: HIJSMM301E1MMJ.27.78.H01.1.454.light.4.raw
  modified_base (489)..(489): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtacaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactgtggctgcaccatntgtctt

SEQ ID NO: 570669 - DNA, 502 bp, Homo sapiens; identical to SEQ ID NO: 543597
  misc_feature: HIJSMM301C5Y8Q.15.25.C03.1.454.light.4.raw

SEQ ID NO: 570670 - DNA, 502 bp, Homo sapiens; identical to SEQ ID NO: 558387
  misc_feature: HIJSMM301A6GI7.43.86.H09.1.454.light.4.raw

SEQ ID NO: 570671 - DNA, 504 bp, Homo sapiens; identical to SEQ ID NO: 537470
  misc_feature: HIJSMM301CKOJ9.18.37.D04.1.454.light.4.raw

SEQ ID NO: 570672 - DNA, 488 bp, Homo sapiens; identical to SEQ ID NO: 537260
  misc_feature: HIJSMM301DL77S.47.70.G04.1.454.light.4.raw

SEQ ID NO: 570673 - DNA, 423 bp, Homo sapiens
  misc_feature: HIJSMM301D943N.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttccccaccctcctcagacgtatca

SEQ ID NO: 570674 - DNA, 506 bp, Homo sapiens
  misc_feature: HIJSMM301CX4JU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtgaagtcaagcgaactgtggctgcaccatctgtcttcatcttccgcc

SEQ ID NO: 570675 - DNA, 500 bp, Homo sapiens; identical to SEQ ID NO: 540012
  misc_feature: HIJSMM301CH0K3.52.34.D01.1.454.light.4.raw

SEQ ID NO: 570676 - DNA, 460 bp, Homo sapiens
  misc_feature: HIJSMM301BZWDP.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggcaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 570677 - DNA, 488 bp, Homo sapiens
  misc_feature: HIJSMM301DEBYN.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctcctggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatacaaacgaactgtggctgcaccat

SEQ ID NO: 570678 - DNA, 489 bp, Homo sapiens
  misc_feature: HIJSMM301CSJ98.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcatttctcaccatcagcagcctgcagtctgaagattttgcagtttattactgtcagcagtataatgactggcctccgacgttcggccaagggaccaaggtggaaatcaaacgaactgtggctgcaccat

SEQ ID NO: 570679 - DNA, 497 bp, Homo sapiens; identical to SEQ ID NO: 539718
  misc_feature: HIJSMM301DUD6L.40.54.E10.1.454.light.4.raw

SEQ ID NO: 570680 - DNA, 484 bp, Homo sapiens
  misc_feature: HIJSMM301AWVH5.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaagctgccccctcggtcac

SEQ ID NO: 570681 - DNA, 495 bp, Homo sapiens; identical to SEQ ID NO: 542299
  misc_feature: HIJSMM301CV67O.22.86.H09.1.454.light.4.raw

SEQ ID NO: 570682 - DNA, 489 bp, Homo sapiens
  misc_feature: HIJSMM301EUOR1.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtaccacttttggccaggggaccaaactggacatcaaacgaactgtggctgcaccatctgtt

SEQ ID NO: 570683 - DNA, 520 bp, Homo sapiens
  misc_feature: HIJSMM301C2X2T.27.23.C01.1.454.light.4.raw
  modified_base (510)..(510): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcngttcccacct

SEQ ID NO: 570684 - DNA, 486 bp, Homo sapiens; identical to SEQ ID NO: 535043
  misc_feature: HIJSMM301B04YX.46.35.D02.1.454.light.4.raw

SEQ ID NO: 570685 - DNA, 524 bp, Homo sapiens
  misc_feature: HIJSMM301AWB6H.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccacgggaccgaacggtagggaaggtacgaaacgaaactacgtggcgtgcgaccactctgtcttctactcttcccgtcccact

SEQ ID NO: 570686 - DNA, 495 bp, Homo sapiens; identical to SEQ ID NO: 550081
  misc_feature: HIJSMM301EYASU.43.39.D06.1.454.light.4.raw

SEQ ID NO: 570687 - DNA, 474 bp, Homo sapiens
  misc_feature: HIJSMM301EP5VD.48.86.H09.1.454.light.4.raw
agtatacatacacgaccggtgctcgatttagtgctatagacttgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 570688 - DNA, 487 bp, Homo sapiens
  misc_feature: HIJSMM301CS4DV.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagtatttcactctcaccatcaatcacctgcaggctgaggattttgcaacttactactgtcagcaggctaacaggctcgcccccaaccttcggccaggggacacgactggagattaaacgaactgtggctgcaccatctgt

SEQ ID NO: 570689 - DNA, 477 bp, Homo sapiens; identical to SEQ ID NO: 541452
  misc_feature: HIJSMM301CB79Z.21.25.C03.1.454.light.4.raw

SEQ ID NO: 570690 - DNA, 498 bp, Homo sapiens
  misc_feature: HIJSMM301D07UX.49.28.C06.1.454.light.4.raw
agtcgagagacacgaccggtgctcgatttagagctcacgtattgggtttggggggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctacaccatcagcagcctgcagtctgaagtattttgctagtttattactgtcagcagtataattactggcttcgttttcggccgaggggaccgaagcgtggaggatacaagacgtaactggtggctgcaccatctgtt

SEQ ID NO: 570691 - DNA, 492 bp, Homo sapiens; identical to SEQ ID NO: 558121
  misc_feature: HIJSMM301AMM1E.9.34.D01.1.454.light.4.raw

SEQ ID NO: 570692 - DNA, 507 bp, Homo sapiens; identical to SEQ ID NO: 538063
  misc_feature: HIJSMM301EHQI5.47.85.H08.1.454.light.4.raw

SEQ ID NO: 570693 - DNA, 505 bp, Homo sapiens
  misc_feature: HIJSMM301ATG59.48.38.D05.1.454.light.4.raw
agtatacatacacgaccggtgctcgatttagtatctgatagttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 570694 - DNA, 520 bp, Homo sapiens
  misc_feature: HIJSMM301CTDLC.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctggggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgt

SEQ ID NO: 570695 - DNA, 504 bp, Homo sapiens
  misc_feature: HIJSMM301A3W85.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccggggccgaggatgaggctgattattactgtgcaggatgggatgacaacctgggtgcttatctcttcggacctgggaccaaggtcaccgtccttggt

SEQ ID NO: 570696 - DNA, 486 bp, Homo sapiens; identical to SEQ ID NO: 535043
  misc_feature: HIJSMM301BWFG3.46.35.D02.1.454.light.4.raw

SEQ ID NO: 570697 - DNA, 504 bp, Homo sapiens; identical to SEQ ID NO: 544677
  misc_feature: HIJSMM301BVGRE.7.71.G05.1.454.light.4.raw

SEQ ID NO: 570698 - DNA, 502 bp, Homo sapiens; identical to SEQ ID NO: 552462
  misc_feature: HIJSMM301BOVTT.27.78.H01.1.454.light.4.raw

SEQ ID NO: 570699 - DNA, 484 bp, Homo sapiens
  misc_feature: HIJSMM301A78FU.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccagggacacgactggagattaaacgaactgtggctgcaccatctgtt

SEQ ID NO: 570700 - DNA, 488 bp, Homo sapiens
  misc_feature: HIJSMM301ES9HJ.49.27.C05.1.454.light.4.raw
agtcgagagacacgaccggtgctcgatttagacgcgatcgaagggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 570701 - DNA, 509 bp, Homo sapiens
  misc_feature: HIJSMM301DHGH3.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctcgttcccaccct

SEQ ID NO: 570702 - DNA, 488 bp, Homo sapiens; identical to SEQ ID NO: 537260
  misc_feature: HIJSMM301BQWIR.47.70.G04.1.454.light.4.raw

SEQ ID NO: 570703 - DNA, 485 bp, Homo sapiens; identical to SEQ ID NO: 536040
  misc_feature: HIJSMM301BOSLD.15.1.A01.1.454.light.4.raw

SEQ ID NO: 570704 - DNA, 441 bp, Homo sapiens; identical to SEQ ID NO: 535074
  misc_feature: HIJSMM301BSM5C.11.3.A03.1.454.light.4.raw

SEQ ID NO: 570705 - DNA, 508 bp, Homo sapiens
  misc_feature: HIJSMM301ASI0W.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcca

SEQ ID NO: 570706 - DNA, 503 bp, Homo sapiens
  misc_feature: HIJSMM301CK4FV.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtctcatcttccgcc

SEQ ID NO: 570707 - DNA, 481 bp, Homo sapiens; identical to SEQ ID NO: 535993
  misc_feature: HIJSMM301AOQXR.21.25.C03.1.454.light.4.raw

SEQ ID NO: 570708 - DNA, 480 bp, Homo sapiens; identical to SEQ ID NO: 535291
  misc_feature: HIJSMM301D0X02.22.59.F04.1.454.light.4.raw

SEQ ID NO: 570709 - DNA, 485 bp, Homo sapiens; identical to SEQ ID NO: 551636
  misc_feature: HIJSMM301AX6MC.3.10.A10.1.454.light.4.raw

SEQ ID NO: 570710 - DNA, 487 bp, Homo sapiens; identical to SEQ ID NO: 536536
  misc_feature: HIJSMM301EJDZY.26.45.E01.1.454.light.4.raw

SEQ ID NO: 570711 - DNA, 504 bp, Homo sapiens
  misc_feature: HIJSMM301DP6ZW.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcta

SEQ ID NO: 570712 - DNA, 510 bp, Homo sapiens
  misc_feature: HIJSMM301C8EYM.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 570713 - DNA, 504 bp, Homo sapiens; identical to SEQ ID NO: 535077
  misc_feature: HIJSMM301A3ELB.8.28.C06.1.454.light.4.raw

SEQ ID NO: 570714 - DNA, 487 bp, Homo sapiens
  misc_feature: HIJSMM301EA3UY.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaaagctggagatcaaacgaaactgtggctgcacc

SEQ ID NO: 570715 - DNA, 486 bp, Homo sapiens; identical to SEQ ID NO: 535408
  misc_feature: HIJSMM301CE52A.12.31.C09.1.454.light.4.raw

SEQ ID NO: 570716 - DNA, 516 bp, Homo sapiens
  misc_feature: HIJSMM301AM3GT.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctacg

SEQ ID NO: 570717 - DNA, 489 bp, Homo sapiens; identical to SEQ ID NO: 543840
  misc_feature: HIJSMM301AR05V.12.88.H11.1.454.light.4.raw

SEQ ID NO: 570718 - DNA, 505 bp, Homo sapiens
  misc_feature: HIJSMM301CIYAD.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttaataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcagcagccgtatactcttcggcggagggaccaagctgaccgtcctaggtcagcccaaggctgccccctcggtcacc

SEQ ID NO: 570719 - DNA, 484 bp, Homo sapiens; identical to SEQ ID NO: 535441
  misc_feature: HIJSMM301AK9I2.26.60.F05.1.454.light.4.raw

SEQ ID NO: 570720 - DNA, 466 bp, Homo sapiens
  misc_feature: HIJSMM301B2ZOF.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaattttcggccctcgggaccagagtggacatgaaacgaaa

SEQ ID NO: 570721 - DNA, 516 bp, Homo sapiens; identical to SEQ ID NO: 536108
  misc_feature: HIJSMM301BA0Q7.22.30.C08.1.454.light.4.raw

SEQ ID NO: 570722 - DNA, 489 bp, Homo sapiens; identical to SEQ ID NO: 535139
  misc_feature: HIJSMM301CVYX2.14.55.E11.1.454.light.4.raw

SEQ ID NO: 570723 - DNA, 494 bp, Homo sapiens; identical to SEQ ID NO: 539894
  misc_feature: HIJSMM301DAM8Q.16.53.E09.1.454.light.4.raw

SEQ ID NO: 570724 - DNA, 487 bp, Homo sapiens
  misc_feature: HIJSMM301DTRCW.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggcgaccaagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 570725 - DNA, 496 bp, Homo sapiens; identical to SEQ ID NO: 537925
  misc_feature: HIJSMM301D6VBT.22.14.B03.1.454.light.4.raw

SEQ ID NO: 570726 - DNA, 506 bp, Homo sapiens
  misc_feature: HIJSMM301B1PK6.48.23.C01.1.454.light.4.raw
agtatacatacacgaccggtgctcgatttagtacacgtgattagggattgggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtggatgacagcctgaatgcttgggtgttcggcggagggaccaagttgaccgtcctaggtcaaccaaggctgccccctc

SEQ ID NO: 570727 - DNA, 510 bp, Homo sapiens
  misc_feature: HIJSMM301C0SRM.48.53.E09.1.454.light.4.raw
agtatacatacacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaaacgaactagtggctgcaccatctgtctt

SEQ ID NO: 570728 - DNA, 489 bp, Homo sapiens
  misc_feature: HIJSMM301C1GPY.48.25.C03.1.454.light.4.raw
  modified_base (440)..(440): a, c, t, g, unknown or other
agtatacatacacgaccggtgctcgatttagtagtgtagatttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtccctcagggatccctgagcgattctctggctccagctctgggacgacactcactctgactatcagtgaagtccggcagaagacgaggctgactactattgtcagtcaggagacaatactcgcacgcaagtacngttcggcggagggaccaagctgacagtcctaggtcagcccaaggctccg

SEQ ID NO: 570729 - DNA, 481 bp, Homo sapiens; identical to SEQ ID NO: 535993
  misc_feature: HIJSMM301DEF3M.21.25.C03.1.454.light.4.raw

SEQ ID NO: 570730 - DNA, 521 bp, Homo sapiens
  misc_feature: HIJSMM301C7M6L.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaaagatattgcagtttactactgtcagcagtatgttacgtccccgtggacgttcggccaagggaccaaggtaggcaatcaaccgaaactgtggctgcaccatctgtcttcatcttccccg

SEQ ID NO: 570731 - DNA, 490 bp, Homo sapiens; identical to SEQ ID NO: 537951
  misc_feature: HIJSMM301CF4EZ.19.57.F02.1.454.light.4.raw

SEQ ID NO: 570732 - DNA, 519 bp, Homo sapiens
  misc_feature: HIJSMM301D13QT.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaacgggaccgaacggtaggacgatcaagacgaacctagtggtcgtgcacccaactctgtcttctactcttcccgtccctact

SEQ ID NO: 570733 - DNA, 353 bp, Homo sapiens; identical to SEQ ID NO: 536338
  misc_feature: HIJSMM301A5OOW.3.11.A11.1.454.light.4.raw

SEQ ID NO: 570734 - DNA, 497 bp, Homo sapiens; identical to SEQ ID NO: 547695
  misc_feature: HIJSMM301DYMPJ.52.38.D05.1.454.light.4.raw

SEQ ID NO: 570735 - DNA, 507 bp, Homo sapiens
  misc_feature: HIJSMM301CFWLJ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggataatcaaacgaaactgtggctgcaccatctgtctt

SEQ ID NO: 570736 - DNA, 509 bp, Homo sapiens
  misc_feature: HIJSMM301ASSNN.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaaggaccgggtggaaataaaacgaactagtggctgcaccatctgtcttcatt

SEQ ID NO: 570737 - DNA, 511 bp, Homo sapiens
  misc_feature: HIJSMM301BHNQ0.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcctaaggctgccccctcggtcact

SEQ ID NO: 570738 - DNA, 460 bp, Homo sapiens; identical to SEQ ID NO: 536053
  misc_feature: HIJSMM301AG5CW.22.28.C06.1.454.light.4.raw

SEQ ID NO: 570739 - DNA, 495 bp, Homo sapiens
  misc_feature: HIJSMM301C0IYJ.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttgcggaggaccgaagtggaggatcaaacgaactgtggctgcaccatctgtcttcta

SEQ ID NO: 570740 - DNA, 501 bp, Homo sapiens; identical to SEQ ID NO: 536867
  misc_feature: HIJSMM301D9W66.5.86.H09.1.454.light.4.raw

SEQ ID NO: 570741 - DNA, 519 bp, Homo sapiens; identical to SEQ ID NO: 535198
  misc_feature: HIJSMM301D7I8E.19.80.H03.1.454.light.4.raw

SEQ ID NO: 570742 - DNA, 504 bp, Homo sapiens; identical to SEQ ID NO: 542288
  misc_feature: HIJSMM301E3LZV.8.28.C06.1.454.light.4.raw

SEQ ID NO: 570743 - DNA, 510 bp, Homo sapiens; identical to SEQ ID NO: 544815
  misc_feature: HIJSMM301DX9ZS.17.41.D08.1.454.light.4.raw

SEQ ID NO: 570744 - DNA, 480 bp, Homo sapiens
  misc_feature: HIJSMM301EP9O9.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcgagggaccaaggtgagatcaaagaa

SEQ ID NO: 570745 - DNA, 486 bp, Homo sapiens; identical to SEQ ID NO: 535043
  misc_feature: HIJSMM301ANB5P.46.35.D02.1.454.light.4.raw

SEQ ID NO: 570746 - DNA, 481 bp, Homo sapiens
  misc_feature: HIJSMM301EM2YE.16.81.H04.1.454.light.4.raw
  modified_base (471)..(471): a, c, t, g, unknown or other
  modified_base (474)..(474): a, c, t, g, unknown or other
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctcggacgaatgtggagtatcaaacgaactagtggntgnaccatct

SEQ ID NO: 570747 - DNA, 494 bp, Homo sapiens; identical to SEQ ID NO: 535629
  misc_feature: HIJSMM301B9J0Q.4.27.C05.1.454.light.4.raw

SEQ ID NO: 570748 - DNA, 496 bp, Homo sapiens
  misc_feature: HIJSMM301C6N1M.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgccatctgactac

SEQ ID NO: 570749 - DNA, 446 bp, Homo sapiens
  misc_feature: HIJSMM301BAX30.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaggtcaccgtcctaagtcagcccaaggccaacccctctgtcactctgttcccaccctcctccatactcgta

SEQ ID NO: 570750 - DNA, 466 bp, Homo sapiens; identical to SEQ ID NO: 536398
  misc_feature: HIJSMM301EXCSG.3.20.B09.1.454.light.4.raw

SEQ ID NO: 570751 - DNA, 506 bp, Homo sapiens
  misc_feature: HIJSMM301CUT1M.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggcaccctgaccatcagcagggtcgaagccgggatgaggccgactattactgtcaggtgtgggatagtagtggtgatcatccatacgtcttcggaactgggaccaaggtctccgtcctacgtcagcccaaggccaacccactgtcactctgttccca

SEQ ID NO: 570752 - DNA, 516 bp, Homo sapiens
  misc_feature: HIJSMM301BA501.51.27.C05.1.454.light.4.raw
cgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcaatcgcttctctggctccaagtccggcaacacggcctccctgaccatctctgggctccaggccgaggacgaggctgattattactgcacctcatatacaagcagcaacaattgggtgttcggcggagggaccaagctgaccgtctaggtcagcccaaggctcgccccctcggtcactctcgttccccg

SEQ ID NO: 570753 - DNA, 506 bp, Homo sapiens; identical to SEQ ID NO: 534969
  misc_feature: HIJSMM301CM0QZ.18.37.D04.1.454.light.4.raw

SEQ ID NO: 570754 - DNA, 520 bp, Homo sapiens
  misc_feature: HIJSMM301A37W3.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggtcggggggaccggaacggtagggaggttacgtaaacgaaaccgtagttgggcgtcgcacccaactctcgttcttctactt

SEQ ID NO: 570755 - DNA, 475 bp, Homo sapiens; identical to SEQ ID NO: 564797
  misc_feature: HIJSMM301DILC8.7.81.H04.1.454.light.4.raw

SEQ ID NO: 570756 - DNA, 485 bp, Homo sapiens; identical to SEQ ID NO: 536576
  misc_feature: HIJSMM301BF3WK.46.35.D02.1.454.light.4.raw

SEQ ID NO: 570757 - DNA, 481 bp, Homo sapiens
  misc_feature: HIJSMM301CZ83K.3.46.E02.1.454.light.4.raw
agacgcactccacgaccggtgctcgatttagactcatctacagggaaaggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagatttgcagttatttctgtcagcagtttacacctggcctggaagttttggccaggggaccaagctggagctcaaacgaactgtggctgcaccat

SEQ ID NO: 570758 - DNA, 497 bp, Homo sapiens; identical to SEQ ID NO: 535664
  misc_feature: HIJSMM301AII2Q.22.14.B03.1.454.light.4.raw

SEQ ID NO: 570759 - DNA, 487 bp, Homo sapiens; identical to SEQ ID NO: 538190
  misc_feature: HIJSMM301DJ1N9.47.70.G04.1.454.light.4.raw

SEQ ID NO: 570760 - DNA, 506 bp, Homo sapiens; identical to SEQ ID NO: 565966
  misc_feature: HIJSMM301CD4P5.19.85.H08.1.454.light.4.raw

SEQ ID NO: 570761 - DNA, 514 bp, Homo sapiens; identical to SEQ ID NO: 537341
  misc_feature: HIJSMM301CAGGL.9.20.B09.1.454.light.4.raw

SEQ ID NO: 570762 - DNA, 490 bp, Homo sapiens
  misc_feature: HIJSMM301BYRKX.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaagggtggagatcaaacgaactgtggctgcaccatctgtcttcta

SEQ ID NO: 570763 - DNA, 469 bp, Homo sapiens; identical to SEQ ID NO: 536091
  misc_feature: HIJSMM301BUJBT.3.82.H05.1.454.light.4.raw

SEQ ID NO: 570764 - DNA, 491 bp, Homo sapiens
  misc_feature: HIJSMM301A5INF.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatgcaggcagcaccaatttggtgttcggcggagggaccaagctgaccgtctaggtcagccaaggctgccccctggtcactctgttcccaccctcctcgtat

SEQ ID NO: 570765 - DNA, 486 bp, Homo sapiens
  misc_feature: HIJSMM301ASQNC.51.24.C02.1.454.light.4.raw
cgatcgtatacacgaccggtgctcgatttagtacagatcgttagggaaagggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 570766 - DNA, 510 bp, Homo sapiens
  misc_feature: HIJSMM301ASC6C.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtaggaggatcaaacgaaactgtggctgcaccatctgtt

SEQ ID NO: 570767 - DNA, 494 bp, Homo sapiens; identical to SEQ ID NO: 534994
  misc_feature: HIJSMM301D48YJ.27.78.H01.1.454.light.4.raw

SEQ ID NO: 570768 - DNA, 495 bp, Homo sapiens; identical to SEQ ID NO: 542416
  misc_feature: HIJSMM301AP995.27.78.H01.1.454.light.4.raw

SEQ ID NO: 570769 - DNA, 492 bp, Homo sapiens; identical to SEQ ID NO: 534967
  misc_feature: HIJSMM301D5KHT.47.64.F09.1.454.light.4.raw

SEQ ID NO: 570770 - DNA, 507 bp, Homo sapiens
  misc_feature: HIJSMM301AHVJC.48.15.B04.1.454.light.4.raw
agtatacatacacgaccggtgctcgatttagacagtatatatccgcgggcacgaccggtgctcgatttagacagtatatatccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgtcggccaggaccgggtac

SEQ ID NO: 570771 - DNA, 500 bp, Homo sapiens
  misc_feature: HIJSMM301EMZ2Z.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaacggtgggaaagtacaaacgaaacctagttggcgtggcacccaa

SEQ ID NO: 570772 - DNA, 497 bp, Homo sapiens
  misc_feature: HIJSMM301DQCHY.51.59.F04.1.454.light.4.raw
cgatcgtatacacgaccggtgctcgatttagtacacacacttagggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcactctcg

SEQ ID NO: 570773 - DNA, 520 bp, Homo sapiens; identical to SEQ ID NO: 535686
  misc_feature: HIJSMM301AVJYB.41.19.B08.1.454.light.4.raw

SEQ ID NO: 570774 - DNA, 486 bp, Homo sapiens; identical to SEQ ID NO: 535043
  misc_feature: HIJSMM301AJJZT.46.35.D02.1.454.light.4.raw

SEQ ID NO: 570775 - DNA, 494 bp, Homo sapiens
  misc_feature: HIJSMM301DTA70.3.14.B03.1.454.light.4.raw
agacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctgtgggggaaacaaaattggagataaaagtgtgcactggtaccagcagaagccaggccaggcccctgtgctggtcatccattctgatagcgaccgcccctcagggatccctgagcgattctctggctccaactctgcgaacacggccaccctgaccatcagcagggtcgaagccggggatgaggccgactattcttgtcaggtgtgggatagtagtactgtgatattcggcggagggaccaagctgaccgtcctaggtcagcccaaggctgccccctcggtcactctgttcccaccctcctcgagtgcgtct

SEQ ID NO: 570776 - DNA, 495 bp, Homo sapiens; identical to SEQ ID NO: 538673
  misc_feature: HIJSMM301D4BQ0.51.35.D02.1.454.light.4.raw

SEQ ID NO: 570777 - DNA, 508 bp, Homo sapiens; identical to SEQ ID NO: 540739
  misc_feature: HIJSMM301BURYS.14.7.A07.1.454.light.4.raw

SEQ ID NO: 570778 - DNA, 492 bp, Homo sapiens
  misc_feature: HIJSMM301C8T41.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgactagtgg

SEQ ID NO: 570779 - DNA, 497 bp, Homo sapiens
  misc_feature: HIJSMM301BKZG8.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactactgttcccaccctcct

SEQ ID NO: 570780 - DNA, 511 bp, Homo sapiens
  misc_feature: HIJSMM301EI6QV.40.9.A09.1.454.light.4.raw
tctagcgactcacgaccggtgctcgatttagcgagacgcgcagggcacgaccggtgctcgatttagacgcgatcgaagggtttggggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggccccgaggatgaggcggattattattgtgtgtcatgggatggacagaatgaatggtccggtgttcggcggagggaccagg

SEQ ID NO: 570781 - DNA, 501 bp, Homo sapiens; identical to SEQ ID NO: 535746
  misc_feature: HIJSMM301EKAWW.18.11.A11.1.454.light.4.raw

SEQ ID NO: 570782 - DNA, 480 bp, Homo sapiens; identical to SEQ ID NO: 535291
  misc_feature: HIJSMM301AKTW6.22.59.F04.1.454.light.4.raw

SEQ ID NO: 570783 - DNA, 516 bp, Homo sapiens
  misc_feature: HIJSMM301EJCQ5.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggcactctgttcccacctcctcacg

SEQ ID NO: 570784 - DNA, 506 bp, Homo sapiens
  misc_feature: HIJSMM301BEU3P.8.28.C06.1.454.light.4.raw
ctcgcgtgtccacgaccggtgctcgatttagagctcacgtattgggtttggggggaactgctcagttaggacccagacggaaccatggaagccccacgcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 570785 - DNA, 515 bp, Homo sapiens; identical to SEQ ID NO: 558526
  misc_feature: HIJSMM301BKLWB.16.85.H08.1.454.light.4.raw

SEQ ID NO: 570786 - DNA, 486 bp, Homo sapiens; identical to SEQ ID NO: 535043
  misc_feature: HIJSMM301BH2HR.46.35.D02.1.454.light.4.raw

SEQ ID NO: 570787 - DNA, 486 bp, Homo sapiens
  misc_feature: HIJSMM301EI45A.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcat

SEQ ID NO: 570788 - DNA, 520 bp, Homo sapiens
  misc_feature: HIJSMM301E4E19.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactaggcctctcacccttcggtcgggacgggaccgaacggtagggaggagtactaaaccgaaaccgtaacgtgggtcgtcgcgacccaactcttgtt

SEQ ID NO: 570789 - DNA, 501 bp, Homo sapiens
  misc_feature: HIJSMM301DKM84.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagtcaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtccactctgttcccta

SEQ ID NO: 570790 - DNA, 500 bp, Homo sapiens
  misc_feature: HIJSMM301ESHPV.22.14.B03.1.454.light.4.raw
  modified_base (494)..(494): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggcaaggaccaaggtaggaaatacaaaacgaactagtggtcgngacaca

SEQ ID NO: 570791 - DNA, 506 bp, Homo sapiens; identical to SEQ ID NO: 535058
  misc_feature: HIJSMM301DR3WI.17.41.D08.1.454.light.4.raw

SEQ ID NO: 570792 - DNA, 520 bp, Homo sapiens
  misc_feature: HIJSMM301BBO1Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataacttttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttccgccct

SEQ ID NO: 570793 - DNA, 507 bp, Homo sapiens; identical to SEQ ID NO: 561702
  misc_feature: HIJSMM301BLB3B.5.24.C02.1.454.light.4.raw

SEQ ID NO: 570794 - DNA, 521 bp, Homo sapiens; identical to SEQ ID NO: 539470
  misc_feature: HIJSMM301BNAD5.27.23.C01.1.454.light.4.raw

SEQ ID NO: 570795 - DNA, 505 bp, Homo sapiens; identical to SEQ ID NO: 535503
  misc_feature: HIJSMM301AN640.8.28.C06.1.454.light.4.raw

SEQ ID NO: 570796 - DNA, 488 bp, Homo sapiens
  misc_feature: HIJSMM301EOU62.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctcaggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagtcccaaggaccaaccca

SEQ ID NO: 570797 - DNA, 504 bp, Homo sapiens
  misc_feature: HIJSMM301CY5UC.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcg

SEQ ID NO: 570798 - DNA, 506 bp, Homo sapiens
  misc_feature: HIJSMM301AWSE4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggacccaaacgtgaccgtcctaggtcaggcccaa

SEQ ID NO: 570799 - DNA, 509 bp, Homo sapiens
  misc_feature: HIJSMM301CR0XW.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgagactgattattactgcagcttatatacaggcaacaatacttttgtcttcggaactgggaccaaggtcaccgtctaggtcagcccaaggccaacccactcgtcactctcg

SEQ ID NO: 570800 - DNA, 481 bp, Homo sapiens
  misc_feature: HIJSMM301CIAUU.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 570801 - DNA, 493 bp, Homo sapiens
  misc_feature: HIJSMM301DXESJ.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactgtggctgcaccatctgt

SEQ ID NO: 570802 - DNA, 521 bp, Homo sapiens; identical to SEQ ID NO: 540400
  misc_feature: HIJSMM301D8ZS8.27.23.C01.1.454.light.4.raw

SEQ ID NO: 570803 - DNA, 503 bp, Homo sapiens; identical to SEQ ID NO: 536834
  misc_feature: HIJSMM301AVN68.2.35.D02.1.454.light.4.raw

SEQ ID NO: 570804 - DNA, 512 bp, Homo sapiens
  misc_feature: HIJSMM301DIHRU.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcgtctgat

SEQ ID NO: 570805 - DNA, 441 bp, Homo sapiens
  misc_feature: HIJSMM301DTU95.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacttcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 570806 - DNA, 508 bp, Homo sapiens; identical to SEQ ID NO: 541988
  misc_feature: HIJSMM301BGTKN.5.60.F05.1.454.light.4.raw

SEQ ID NO: 570807 - DNA, 504 bp, Homo sapiens
  misc_feature: HIJSMM301BDSPC.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcggtagtagcactttcgatgtcctattcggcggagggaccaaggctgaccgtcctgggtcagcccaaggctgcccctcggtcactctgttcccgccctcctcctacgtcgtat

SEQ ID NO: 570808 - DNA, 505 bp, Homo sapiens
  misc_feature: HIJSMM301C468V.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaaccccactgtcta

SEQ ID NO: 570809 - DNA, 486 bp, Homo sapiens
  misc_feature: HIJSMM301BMZ5Q.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgtcgcaccgtttggccaggggaccaaggtagagatcaaacgaactgtggctgcaccat

SEQ ID NO: 570810 - DNA, 490 bp, Homo sapiens; identical to SEQ ID NO: 538866
  misc_feature: HIJSMM301B76EQ.40.81.H04.1.454.light.4.raw

SEQ ID NO: 570811 - DNA, 488 bp, Homo sapiens
  misc_feature: HIJSMM301EZJ1M.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccaagggaccaaggtggaaatcaaacgaactgtggctgcaccatctgtcttcta

SEQ ID NO: 570812 - DNA, 489 bp, Homo sapiens; identical to SEQ ID NO: 535091
  misc_feature: HIJSMM301BP3WC.47.36.D03.1.454.light.4.raw

SEQ ID NO: 570813 - DNA, 484 bp, Homo sapiens; identical to SEQ ID NO: 540581
  misc_feature: HIJSMM301C2A2W.3.88.H11.1.454.light.4.raw

SEQ ID NO: 570814 - DNA, 483 bp, Homo sapiens
  misc_feature: HIJSMM301AE9EC.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaaacgaactgtggctgcac

SEQ ID NO: 570815 - DNA, 521 bp, Homo sapiens
  misc_feature: HIJSMM301CSBGS.40.42.D09.1.454.light.4.raw
tctagcgactcacgaccggtgctcgatttagacacatacgcagggaaaggggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttccccaccctcctcagtcgctaga

SEQ ID NO: 570816 - DNA, 504 bp, Homo sapiens; identical to SEQ ID NO: 538940
  misc_feature: HIJSMM301C2RKS.2.35.D02.1.454.light.4.raw

SEQ ID NO: 570817 - DNA, 496 bp, Homo sapiens
  misc_feature: HIJSMM301EHH8Y.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccgaggggaccgaagctggagatcaaacgaactgtggctgcaccatctgtctt

SEQ ID NO: 570818 - DNA, 523 bp, Homo sapiens
  misc_feature: HIJSMM301BBGX7.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctgttcccgccctcctccgtcg

SEQ ID NO: 570819 - DNA, 454 bp, Homo sapiens; identical to SEQ ID NO: 535005
  misc_feature: HIJSMM301CEL4J.19.86.H09.1.454.light.4.raw

SEQ ID NO: 570820 - DNA, 490 bp, Homo sapiens; identical to SEQ ID NO: 535420
  misc_feature: HIJSMM301B6DOM.3.72.G06.1.454.light.4.raw

SEQ ID NO: 570821 - DNA, 486 bp, Homo sapiens; identical to SEQ ID NO: 535043
  misc_feature: HIJSMM301BKCCC.46.35.D02.1.454.light.4.raw

SEQ ID NO: 570822 - DNA, 485 bp, Homo sapiens; identical to SEQ ID NO: 535880
  misc_feature: HIJSMM301AYY9U.7.75.G09.1.454.light.4.raw

SEQ ID NO: 570823 - DNA, 499 bp, Homo sapiens; identical to SEQ ID NO: 545202
  misc_feature: HIJSMM301D0UUO.12.26.C04.1.454.light.4.raw

SEQ ID NO: 570824 - DNA, 487 bp, Homo sapiens
  misc_feature: HIJSMM301BBRHH.49.56.F01.1.454.light.4.raw
agtcgagagacacgaccggtgctcgatttagcagacgtctgaacacacaaagggggcaggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggcaactttttaaattggtatcaacacaaaccagggaaagcccctaaactcctgatctatgctgcatccactttgcaaagtggggtcccttcaaggttccgtggcggtggatctgggacagatttcgctctcaccatcagcagtctccagcctgaagattttgcgacttactactgtcaacagagtttctctgacctcactttcggcggagggaccacggtggacatcaaacgaactgtggctgcaccat

SEQ ID NO: 570825 - DNA, 493 bp, Homo sapiens
  misc_feature: HIJSMM301C4BPY.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccatgcagaagacgaggctgactattactgtcaatcagcagacagcagtggtactttcgggttttcggcggagggaccaagctgaccgtcctaggtcagcccaaggctgccccctc

SEQ ID NO: 570826 - DNA, 492 bp, Homo sapiens
  misc_feature: HIJSMM301A5FUN.16.68.G02.1.454.light.4.raw
  modified_base (471)..(471): a, c, t, g, unknown or other
  modified_base (473)..(473): a, c, t, g, unknown or other
  modified_base (481)..(481): a, c, t, g, unknown or other
  modified_base (490)..(490): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggataacaaacgactgngntgaccacntctgttctnta

SEQ ID NO: 570827 - DNA, 485 bp, Homo sapiens
  misc_feature: HIJSMM301EQWHF.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaaggggacacgactggagattaaacgaactgtggctgcaccat

SEQ ID NO: 570828 - DNA, 496 bp, Homo sapiens; identical to SEQ ID NO: 535541
  misc_feature: HIJSMM301AXFFT.3.33.C11.1.454.light.4.raw

SEQ ID NO: 570829 - DNA, 492 bp, Homo sapiens; identical to SEQ ID NO: 535126
  misc_feature: HIJSMM301A94D8.18.11.A11.1.454.light.4.raw

SEQ ID NO: 570830 - DNA, 484 bp, Homo sapiens
  misc_feature: HIJSMM301A208C.51.64.F09.1.454.light.4.raw
cgatcgtatacacgaccggtgctcgatttagcgcgtatacaaggggggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcaccatctgt

SEQ ID NO: 570831 - DNA, 503 bp, Homo sapiens; identical to SEQ ID NO: 539785
  misc_feature: HIJSMM301AICM9.48.67.G01.1.454.light.4.raw

SEQ ID NO: 570832 - DNA, 516 bp, Homo sapiens
  misc_feature: HIJSMM301A25RC.43.81.H04.1.454.light.4.raw
tgtgagtagtcacgaccggtgctcgatttagtagtgtagattcgcgggtggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactact

SEQ ID NO: 570833 - DNA, 351 bp, Homo sapiens
  misc_feature: HIJSMM301CORII.4.67.G01.1.454.light.4.raw
agcactgtagcacgaccggtgctcgatttagagtatacatattggttactatgactttgtctcgtggtaccaacaacacccaggcaaagccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccaccctcctcctacagtgct

SEQ ID NO: 570834 - DNA, 441 bp, Homo sapiens; identical to SEQ ID NO: 564890
  misc_feature: HIJSMM301CF68E.41.9.A09.1.454.light.4.raw
  modified_base (423)..(423): a, c, t, g, unknown or other

SEQ ID NO: 570835 - DNA, 509 bp, Homo sapiens
  misc_feature: HIJSMM301A4ASG.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccgaaggtggaagtcaagcgaactgtggctgcaccatctgtcttcatcttcccgcc

SEQ ID NO: 570836 - DNA, 479 bp, Homo sapiens
  misc_feature: HIJSMM301DYBSE.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctccctccactttcggcggagggaccaaggtggagatcaaacgaactgtggctgcacc

SEQ ID NO: 570837 - DNA, 457 bp, Homo sapiens
  misc_feature: HIJSMM301A22D4.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatggacgctgagcggttccttaagggtccctgaccgattctctggcgagaggtctggcgcctcagcttccctggccatcagagggctccagtctgaagatgaggctgattattactgtgcaatctgggatgacagtgtgaacggtccggttttcggtcggagggaccaagctgaccgtcctaagtcagcccaaggctgccccctcggtcactctgttcccgccctcctccacgagagta

SEQ ID NO: 570838 - DNA, 506 bp, Homo sapiens
  misc_feature: HIJSMM301ECUOD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaacggtggaaatacaaacgaactagtggctgcaccatctgtcttcatcttccccg

SEQ ID NO: 570839 - DNA, 495 bp, Homo sapiens; identical to SEQ ID NO: 535143
  misc_feature: HIJSMM301B3TQU.51.29.C07.1.454.light.4.raw

SEQ ID NO: 570840 - DNA, 488 bp, Homo sapiens; identical to SEQ ID NO: 535725
  misc_feature: HIJSMM301DXAZ3.12.88.H11.1.454.light.4.raw

SEQ ID NO: 570841 - DNA, 498 bp, Homo sapiens
  misc_feature: HIJSMM301DWBMU.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaaccca

SEQ ID NO: 570842 - DNA, 492 bp, Homo sapiens
  misc_feature: HIJSMM301CEUSP.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcaccatctgtcttcatt

SEQ ID NO: 570843 - DNA, 489 bp, Homo sapiens; identical to SEQ ID NO: 535139
  misc_feature: HIJSMM301DJ80Q.14.55.E11.1.454.light.4.raw

SEQ ID NO: 570844 - DNA, 484 bp, Homo sapiens; identical to SEQ ID NO: 535441
  misc_feature: HIJSMM301AFN0Q.26.60.F05.1.454.light.4.raw

SEQ ID NO: 570845 - DNA, 502 bp, Homo sapiens
  misc_feature: HIJSMM301C0CV3.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggacgcaacatggacctgacaatctgagcggttgggtgttcggcggagggaccaaactgaccgtcctaggtcagcccaa

SEQ ID NO: 570846 - DNA, 493 bp, Homo sapiens; identical to SEQ ID NO: 536185
  misc_feature: HIJSMM301D6A45.9.19.B08.1.454.light.4.raw

SEQ ID NO: 570847 - DNA, 487 bp, Homo sapiens; identical to SEQ ID NO: 536206
  misc_feature: HIJSMM301BRMC2.47.38.D05.1.454.light.4.raw

SEQ ID NO: 570848 - DNA, 500 bp, Homo sapiens
  misc_feature: HIJSMM301DWWL5.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggggacacggtcaccgtcctaggtcagcccaaggccaacccc

SEQ ID NO: 570849 - DNA, 484 bp, Homo sapiens; identical to SEQ ID NO: 535441
  misc_feature: HIJSMM301AJJWV.26.60.F05.1.454.light.4.raw

SEQ ID NO: 570850 - DNA, 499 bp, Homo sapiens; identical to SEQ ID NO: 567675
  misc_feature: HIJSMM301EULH6.10.28.C06.1.454.light.4.raw

SEQ ID NO: 570851 - DNA, 454 bp, Homo sapiens; identical to SEQ ID NO: 535005
  misc_feature: HIJSMM301BJTZL.19.86.H09.1.454.light.4.raw

SEQ ID NO: 570852 - DNA, 475 bp, Homo sapiens
  misc_feature: HIJSMM301A0Q4L.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgaactgggctccaggctgacgatgaggctgattattattgcagtcctatgacaacacctgcgtggtttgctgttcgcggcggc

SEQ ID NO: 570853 - DNA, 472 bp, Homo sapiens; identical to SEQ ID NO: 535898
  misc_feature: HIJSMM301EHRD5.15.8.A08.1.454.light.4.raw

SEQ ID NO: 570854 - DNA, 489 bp, Homo sapiens; identical to SEQ ID NO: 536013
  misc_feature: HIJSMM301DXV48.26.23.C01.1.454.light.4.raw

SEQ ID NO: 570855 - DNA, 490 bp, Homo sapiens; identical to SEQ ID NO: 535234
  misc_feature: HIJSMM301B5094.17.21.B10.1.454.light.4.raw

SEQ ID NO: 570856 - DNA, 487 bp, Homo sapiens
  misc_feature: HIJSMM301D1CBB.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggaccctgaagattttgcagtgtattactgtcagcagtatggtagctcaccgatcaccttcggccaagggacacgactggagattaaccgaactgtggctgcaccatctgtt

SEQ ID NO: 570857 - DNA, 509 bp, Homo sapiens
  misc_feature: HIJSMM301B30D6.40.48.E04.1.454.light.4.raw
tctagcgactcacgaccggtgctcgatttagagagcgtcacagagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcggggggaccaagctgaccgtcctaggtcagcccaaggctgccccctcggtcact

SEQ ID NO: 570858 - DNA, 502 bp, Homo sapiens
  misc_feature: HIJSMM301AHIJ7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttgtccgaacggaccgaacgtaggagtaatctagacgaacctagtggcgt

SEQ ID NO: 570859 - DNA, 512 bp, Homo sapiens
  misc_feature: HIJSMM301BHV1C.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggacaggtgcaatcacgaactgtggctgcaccatctgtcttcatcttccccg

SEQ ID NO: 570860 - DNA, 503 bp, Homo sapiens
  misc_feature: HIJSMM301E1HUO.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcaggtgggagcaacttcggggtgttcggcggagggaccaagctgaccgtcctaggtcagcccg

SEQ ID NO: 570861 - DNA, 493 bp, Homo sapiens; identical to SEQ ID NO: 537473
  misc_feature: HIJSMM301BR28K.16.6.A06.1.454.light.4.raw

SEQ ID NO: 570862 - DNA, 517 bp, Homo sapiens
  misc_feature: HIJSMM301CTKMJ.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgacccatctctgggctcgagtctgaggacgaggctgattacttctgttgctcttgggcaactactgtcgtttgggtgttcggcggagggaccaagttgaccgtcctaggtcagcccaaggcctgccccctcggtcactctgttcccccg

SEQ ID NO: 570863 - DNA, 499 bp, Homo sapiens; identical to SEQ ID NO: 541446
  misc_feature: HIJSMM301AIQ1G.43.34.D01.1.454.light.4.raw

SEQ ID NO: 570864 - DNA, 510 bp, Homo sapiens; identical to SEQ ID NO: 535855
  misc_feature: HIJSMM301ENGDF.17.33.C11.1.454.light.4.raw

SEQ ID NO: 570865 - DNA, 488 bp, Homo sapiens
  misc_feature: HIJSMM301BRMD6.4.74.G08.1.454.light.4.raw
agcactgtagcacgaccggtgctcgatttagtagctctatcagggggcgaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggacgacgtaaggtaagtaataacgaaacaacgtgtgtcgtgcaa

SEQ ID NO: 570866 - DNA, 474 bp, Homo sapiens
  misc_feature: HIJSMM301BICKT.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtccaagtcagccccg

SEQ ID NO: 570867 - DNA, 498 bp, Homo sapiens
  misc_feature: HIJSMM301DZ5KI.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccaacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcat

SEQ ID NO: 570868 - DNA, 489 bp, Homo sapiens; identical to SEQ ID NO: 554439
  misc_feature: HIJSMM301ERKSD.14.55.E11.1.454.light.4.raw
  modified_base (427)..(427): a, c, t, g, unknown or other

SEQ ID NO: 570869 - DNA, 495 bp, Homo sapiens
  misc_feature: HIJSMM301DK32F.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggcccttgggaccaaagtggagatcaaacgaactgtggctgcaccatctgtctt

SEQ ID NO: 570870 - DNA, 490 bp, Homo sapiens; identical to SEQ ID NO: 544430
  misc_feature: HIJSMM301DKFI4.10.20.B09.1.454.light.4.raw

SEQ ID NO: 570871 - DNA, 486 bp, Homo sapiens; identical to SEQ ID NO: 535043
  misc_feature: HIJSMM301A9G95.46.35.D02.1.454.light.4.raw

SEQ ID NO: 570872 - DNA, 495 bp, Homo sapiens
  misc_feature: HIJSMM301AE09J.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccacccactgtcact

SEQ ID NO: 570873 - DNA, 493 bp, Homo sapiens
  misc_feature: HIJSMM301BRI86.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtccaagggaccaaagtggacgatcaagcgaactgtggctgcaccatctgtt

SEQ ID NO: 570874 - DNA, 493 bp, Homo sapiens
  misc_feature: HIJSMM301AWXK4.14.55.E11.1.454.light.4.raw
  modified_base (455)..(455): a, c, t, g, unknown or other
  modified_base (459)..(459): a, c, t, g, unknown or other
  modified_base (461)..(461): a, c, t, g, unknown or other
  modified_base (484)..(484): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctggaacagatttcactctcaccgtcagcagtctgcaacctgaagattttgcaacttactactgtcaacagagttacagtaccccctcctactacgttcggacggacggaacgaggngganancagactacgtggtgctcgcactntctcgtctt

SEQ ID NO: 570875 - DNA, 499 bp, Homo sapiens; identical to SEQ ID NO: 537739
  misc_feature: HIJSMM301EZG76.12.86.H09.1.454.light.4.raw

SEQ ID NO: 570876 - DNA, 475 bp, Homo sapiens
  misc_feature: HIJSMM301CPRI3.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtgttttggctgttcgcggcggc

SEQ ID NO: 570877 - DNA, 488 bp, Homo sapiens; identical to SEQ ID NO: 540342
  misc_feature: HIJSMM301BB28N.43.33.C11.1.454.light.4.raw

SEQ ID NO: 570878 - DNA, 453 bp, Homo sapiens
  misc_feature: HIJSMM301AEMOP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgcctcctccacgagagta

SEQ ID NO: 570879 - DNA, 464 bp, Homo sapiens
  misc_feature: HIJSMM301AQHVL.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaactgtggctgcaccatctgtcttcatcttcccgccatctgaagtatagtct

SEQ ID NO: 570880 - DNA, 493 bp, Homo sapiens; identical to SEQ ID NO: 535770
  misc_feature: HIJSMM301COEZN.51.71.G05.1.454.light.4.raw

SEQ ID NO: 570881 - DNA, 470 bp, Homo sapiens
  misc_feature: HIJSMM301ENAHY.40.2.A02.1.454.light.4.raw
tctagcgactcacgaccggtgctcgatttagactcatctacagggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggccaggggacctggctggagatcaaacgaactgt

SEQ ID NO: 570882 - DNA, 487 bp, Homo sapiens
  misc_feature: HIJSMM301CGHIG.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggccaagctgaccgtccttggtcagcccaaggctgccccccg

SEQ ID NO: 570883 - DNA, 496 bp, Homo sapiens; identical to SEQ ID NO: 537925
  misc_feature: HIJSMM301CAN03.22.14.B03.1.454.light.4.raw

SEQ ID NO: 570884 - DNA, 508 bp, Homo sapiens
  misc_feature: HIJSMM301BLXCG.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcta

SEQ ID NO: 570885 - DNA, 492 bp, Homo sapiens; identical to SEQ ID NO: 536010
  misc_feature: HIJSMM301A9MW2.10.20.B09.1.454.light.4.raw

SEQ ID NO: 570886 - DNA, 475 bp, Homo sapiens; identical to SEQ ID NO: 560950
  misc_feature: HIJSMM301DH8PA.5.12.B01.1.454.light.4.raw

SEQ ID NO: 570887 - DNA, 447 bp, Homo sapiens; identical to SEQ ID NO: 535201
  misc_feature: HIJSMM301AQ8HS.18.9.A09.1.454.light.4.raw

SEQ ID NO: 570888 - DNA, 497 bp, Homo sapiens
  misc_feature: HIJSMM301DI2QK.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaactgt

SEQ ID NO: 570889 - DNA, 498 bp, Homo sapiens
  misc_feature: HIJSMM301AELR5.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccaggatgaggctgattattactgtgcaggatgggatgacaacctgggtgcttatctcttcggacctgggaccaaggtcaccgtcctt

SEQ ID NO: 570890 - DNA, 503 bp, Homo sapiens; identical to SEQ ID NO: 536313
  misc_feature: HIJSMM301DT21Q.21.22.B11.1.454.light.4.raw

SEQ ID NO: 570891 - DNA, 501 bp, Homo sapiens
  misc_feature: HIJSMM301AIM53.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggagtacaaacgaacctagtggctgcaccactctgtcttcatt

SEQ ID NO: 570892 - DNA, 497 bp, Homo sapiens; identical to SEQ ID NO: 536371
  misc_feature: HIJSMM301CUSJ7.16.78.H01.1.454.light.4.raw

SEQ ID NO: 570893 - DNA, 504 bp, Homo sapiens
  misc_feature: HIJSMM301BVZTD.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcactctgttccca

SEQ ID NO: 570894 - DNA, 500 bp, Homo sapiens; identical to SEQ ID NO: 540484
  misc_feature: HIJSMM301CEAIG.48.73.G07.1.454.light.4.raw

SEQ ID NO: 570895 - DNA, 496 bp, Homo sapiens
  misc_feature: HIJSMM301BCA56.3.58.F03.1.454.light.4.raw
agacgcactccacgaccggtgctcgatttagtctgatcgagaagggaaagggggaggaactgctcagttaggacccagagggaaccatggaagccccagctcagcttctcttcctcctgctactctggctcccagataccaccggagaagttgtgttgacacagtctccagccaccctgtctttgtctccggggaaagagccaccctctcctgcagggccagtcagagtgttagcagatacttagcctggtaccaacagaaacctggccaggctcccaggctcctcatctatgatgcgtccaacagggccactggcatcccagccaggatcagtggcagtgggtctgggacagacttcactctcaccatcagtagcctagagcctcaagattttgctagtttattattgtcaccaccgagccacgttcggccaagggaccaaggtggaaatcaaacgaactgtggctgcaccatctgtcttcatccttcccgccat

SEQ ID NO: 570896 - DNA, 495 bp, Homo sapiens; identical to SEQ ID NO: 545183
  misc_feature: HIJSMM301CCR99.16.10.A10.1.454.light.4.raw

SEQ ID NO: 570897 - DNA, 496 bp, Homo sapiens; identical to SEQ ID NO: 535541
  misc_feature: HIJSMM301CY6QJ.3.33.C11.1.454.light.4.raw

SEQ ID NO: 570898 - DNA, 472 bp, Homo sapiens; identical to SEQ ID NO: 539243
  misc_feature: HIJSMM301AOZK5.18.76.G10.1.454.light.4.raw

SEQ ID NO: 570899 - DNA, 515 bp, Homo sapiens
  misc_feature: HIJSMM301D2F9U.10.38.D05.1.454.light.4.raw
catagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccct

SEQ ID NO: 570900 - DNA, 496 bp, Homo sapiens; identical to SEQ ID NO: 561501
  misc_feature: HIJSMM301ADLGE.27.78.H01.1.454.light.4.raw

SEQ ID NO: 570901 - DNA, 447 bp, Homo sapiens
  misc_feature: HIJSMM301B1WIM.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggtcatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 570902 - DNA, 495 bp, Homo sapiens; identical to SEQ ID NO: 557377
  misc_feature: HIJSMM301AF0K2.41.53.E09.1.454.light.4.raw

SEQ ID NO: 570903 - DNA, 373 bp, Homo sapiens; identical to SEQ ID NO: 539301
  misc_feature: HIJSMM301AW2XO.21.25.C03.1.454.light.4.raw

SEQ ID NO: 570904 - DNA, 419 bp, Homo sapiens
  misc_feature: HIJSMM301BQ26R.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgcccctcggtcactctgttccccaccctcctcatagtataga

SEQ ID NO: 570905 - DNA, 502 bp, Homo sapiens
  misc_feature: HIJSMM301EN3FO.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaaatcaaacgaactagtggctgcaccatctgtctt

SEQ ID NO: 570906 - DNA, 501 bp, Homo sapiens
  misc_feature: HIJSMM301BGIYM.52.78.H01.1.454.light.4.raw
cgcagtacgacacgaccggtgctcgatttagtgtgagtagtttgggtttgggggtggggtccaggaggcagaactctgggtgtctcaccatggcctggatccctctacttctccccctccctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcact

SEQ ID NO: 570907 - DNA, 496 bp, Homo sapiens
  misc_feature: HIJSMM301B1531.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaactagtggctgcaccatctgtcttcat

SEQ ID NO: 570908 - DNA, 497 bp, Homo sapiens; identical to SEQ ID NO: 535740
  misc_feature: HIJSMM301CH6KN.3.71.G05.1.454.light.4.raw

SEQ ID NO: 570909 - DNA, 504 bp, Homo sapiens
  misc_feature: HIJSMM301BO459.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctcggtcta

SEQ ID NO: 570910 - DNA, 473 bp, Homo sapiens
  misc_feature: HIJSMM301DCPOK.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggcctaggggaccaagctggagatcagaacg

SEQ ID NO: 570911 - DNA, 508 bp, Homo sapiens; identical to SEQ ID NO: 554004
  misc_feature: HIJSMM301BMCC8.4.57.F02.1.454.light.4.raw

SEQ ID NO: 570912 - DNA, 505 bp, Homo sapiens
  misc_feature: HIJSMM301C2TD2.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaagggtgaccgtcctaggtcagcccaaggctgccccccg

SEQ ID NO: 570913 - DNA, 518 bp, Homo sapiens; identical to SEQ ID NO: 539372
  misc_feature: HIJSMM301AWXW6.7.86.H09.1.454.light.4.raw

SEQ ID NO: 570914 - DNA, 521 bp, Homo sapiens; identical to SEQ ID NO: 538715
  misc_feature: HIJSMM301B12E8.27.23.C01.1.454.light.4.raw

SEQ ID NO: 570915 - DNA, 483 bp, Homo sapiens
  misc_feature: HIJSMM301AMASQ.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccgaaggtcgaaatgagacgaactgtggctgcaccatctgtt

SEQ ID NO: 570916 - DNA, 494 bp, Homo sapiens
  misc_feature: HIJSMM301D5ZCV.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgcccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcgg

SEQ ID NO: 570917 - DNA, 486 bp, Homo sapiens; identical to SEQ ID NO: 535458
  misc_feature: HIJSMM301DR9VP.7.75.G09.1.454.light.4.raw

SEQ ID NO: 570918 - DNA, 484 bp, Homo sapiens; identical to SEQ ID NO: 535400
  misc_feature: HIJSMM301DNUXN.46.26.C04.1.454.light.4.raw

SEQ ID NO: 570919 - DNA, 519 bp, Homo sapiens
  misc_feature: HIJSMM301ECCZX.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggcgtgcaccatctgtcttcatcttccccg

SEQ ID NO: 570920 - DNA, 508 bp, Homo sapiens
  misc_feature: HIJSMM301ERE22.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccccactgtcact

SEQ ID NO: 570921 - DNA, 507 bp, Homo sapiens
  misc_feature: HIJSMM301ATMM9.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccccactgtcactctgttccccg

SEQ ID NO: 570922 - DNA, 503 bp, Homo sapiens
  misc_feature: HIJSMM301BDWWI.48.27.C05.1.454.light.4.raw
agtatacatacacgaccggtgctcgatttagacgcgatcgaagggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccgcta

SEQ ID NO: 570923 - DNA, 494 bp, Homo sapiens; identical to SEQ ID NO: 535680
  misc_feature: HIJSMM301CTBKG.16.78.H01.1.454.light.4.raw

SEQ ID NO: 570924 - DNA, 498 bp, Homo sapiens
  misc_feature: HIJSMM301A26DK.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgcccccg

SEQ ID NO: 570925 - DNA, 486 bp, Homo sapiens; identical to SEQ ID NO: 535043
  misc_feature: HIJSMM301DWHSF.46.35.D02.1.454.light.4.raw

SEQ ID NO: 570926 - DNA, 521 bp, Homo sapiens
  misc_feature: HIJSMM301D860B.48.25.C03.1.454.light.4.raw
agtatacatacacgaccggtgctcgatttagtagtgtagatttgggtttgggggaggaactgctcagttaggacccagacggaatcatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctccctctatttatgatacatccaccgagggccactggtcgtcccagccaggttcactgggcgggtgggtctgggacagtagttcactctcaccatcagcagcctgcagtctagaagtattttactattttattactgtcagcaagtatcgtaagtggactccgtacgtttggccaaagggaccaagggtggaagtcaaaacgactgtggctgcaccatctgtcttcatccttcccgcta

SEQ ID NO: 570927 - DNA, 484 bp, Homo sapiens
  misc_feature: HIJSMM301D2ER6.49.34.D01.1.454.light.4.raw
agtcgagagacacgaccggtgctcgatttagatcgtctgtgttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaac

SEQ ID NO: 570928 - DNA, 514 bp, Homo sapiens; identical to SEQ ID NO: 541418
  misc_feature: HIJSMM301AUX6M.17.33.C11.1.454.light.4.raw

SEQ ID NO: 570929 - DNA, 466 bp, Homo sapiens; identical to SEQ ID NO: 536398
  misc_feature: HIJSMM301BW1HQ.3.20.B09.1.454.light.4.raw

SEQ ID NO: 570930 - DNA, 508 bp, Homo sapiens; identical to SEQ ID NO: 541327
  misc_feature: HIJSMM301CO06W.47.85.H08.1.454.light.4.raw

SEQ ID NO: 570931 - DNA, 448 bp, Homo sapiens
  misc_feature: HIJSMM301EDCFS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatactcgta

SEQ ID NO: 570932 - DNA, 508 bp, Homo sapiens
  misc_feature: HIJSMM301DFZJE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaactagtggctggcaccatctgtcttcactcttccccg

SEQ ID NO: 570933 - DNA, 487 bp, Homo sapiens; identical to SEQ ID NO: 541583
  misc_feature: HIJSMM301B36D2.41.57.F02.1.454.light.4.raw

SEQ ID NO: 570934 - DNA, 444 bp, Homo sapiens; identical to SEQ ID NO: 536096
  misc_feature: HIJSMM301D2QAT.7.18.B07.1.454.light.4.raw

SEQ ID NO: 570935 - DNA, 484 bp, Homo sapiens
  misc_feature: HIJSMM301DZY80.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaaggggaccaaggtggaaatcaaacgaactgtggctgcaccatctgtctt

SEQ ID NO: 570936 - DNA, 509 bp, Homo sapiens
  misc_feature: HIJSMM301AUNVW.18.78.H01.1.454.light.4.raw
  modified_base (437)..(437): a, c, t, g, unknown or other
  modified_base (442)..(442): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgacccatctctgggctccaggctgaggacgaggctgattattactgcagctcatatacaagcacngcacnctctatgtcgttacgacgtcggaccaaggtccacctcgtagtcacgacccgaacgacccaaccccac

SEQ ID NO: 570937 - DNA, 457 bp, Homo sapiens
  misc_feature: HIJSMM301AHL4U.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgccccctcggtcactctcgttcccaccctccctccacgagagta

SEQ ID NO: 570938 - DNA, 495 bp, Homo sapiens; identical to SEQ ID NO: 537716
  misc_feature: HIJSMM301CDGG3.22.14.B03.1.454.light.4.raw

SEQ ID NO: 570939 - DNA, 473 bp, Homo sapiens
  misc_feature: HIJSMM301B71BR.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaaggaccgaaggtggaaatcaaacgaa

SEQ ID NO: 570940 - DNA, 524 bp, Homo sapiens
  misc_feature: HIJSMM301C6D6X.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccgacggaccgaacggtaggaaggtacaaacgaactacgtggcgtgcgaccatctgtcttctatcttcccgtccgactctcgat

SEQ ID NO: 570941 - DNA, 485 bp, Homo sapiens; identical to SEQ ID NO: 535501
  misc_feature: HIJSMM301ATSEC.3.10.A10.1.454.light.4.raw

SEQ ID NO: 570942 - DNA, 486 bp, Homo sapiens; identical to SEQ ID NO: 535043
  misc_feature: HIJSMM301B9PQX.46.35.D02.1.454.light.4.raw

SEQ ID NO: 570943 - DNA, 509 bp, Homo sapiens; identical to SEQ ID NO: 544485
  misc_feature: HIJSMM301B3K2U.9.33.C11.1.454.light.4.raw

SEQ ID NO: 570944 - DNA, 502 bp, Homo sapiens; identical to SEQ ID NO: 559356
  misc_feature: HIJSMM301ERLPI.48.26.C04.1.454.light.4.raw

SEQ ID NO: 570945 - DNA, 492 bp, Homo sapiens; identical to SEQ ID NO: 537666
  misc_feature: HIJSMM301COCCU.43.33.C11.1.454.light.4.raw

SEQ ID NO: 570946 - DNA, 484 bp, Homo sapiens
  misc_feature: HIJSMM301AXNKT.13.59.F04.1.454.light.4.raw
  modified_base (477)..(477): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgnggctgca

SEQ ID NO: 570947 - DNA, 490 bp, Homo sapiens
  misc_feature: HIJSMM301CYMWF.52.29.C07.1.454.light.4.raw
cgcagtacgacacgaccggtgctcgatttagagtgctacgaagggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccaggggaccaaggctggagatcaaacgaactgtggctgcacc

SEQ ID NO: 570948 - DNA, 503 bp, Homo sapiens
  misc_feature: HIJSMM301BDRC6.15.66.F11.1.454.light.4.raw
  modified_base (500)..(500): a, c, t, g, unknown or other
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccncct

SEQ ID NO: 570949 - DNA, 485 bp, Homo sapiens
  misc_feature: HIJSMM301BQOZK.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggaggatcaaacgaactagtggctgcaccat

SEQ ID NO: 570950 - DNA, 509 bp, Homo sapiens; identical to SEQ ID NO: 541829
  misc_feature: HIJSMM301EZBB1.17.28.C06.1.454.light.4.raw

SEQ ID NO: 570951 - DNA, 500 bp, Homo sapiens; identical to SEQ ID NO: 551915
  misc_feature: HIJSMM301EKRZI.18.11.A11.1.454.light.4.raw

SEQ ID NO: 570952 - DNA, 500 bp, Homo sapiens; identical to SEQ ID NO: 535310
  misc_feature: HIJSMM301CKDZV.47.66.F11.1.454.light.4.raw

SEQ ID NO: 570953 - DNA, 521 bp, Homo sapiens; identical to SEQ ID NO: 538715
  misc_feature: HIJSMM301DZF9J.27.23.C01.1.454.light.4.raw

SEQ ID NO: 570954 - DNA, 495 bp, Homo sapiens; identical to SEQ ID NO: 535007
  misc_feature: HIJSMM301AU184.22.5.A05.1.454.light.4.raw

SEQ ID NO: 570955 - DNA, 504 bp, Homo sapiens
  misc_feature: HIJSMM301CXRHZ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 570956 - DNA, 482 bp, Homo sapiens
  misc_feature: HIJSMM301A4E32.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcaccatctgtctt

SEQ ID NO: 570957 - DNA, 422 bp, Homo sapiens; identical to SEQ ID NO: 537797
  misc_feature: HIJSMM301A9GHD.9.34.D01.1.454.light.4.raw

SEQ ID NO: 570958 - DNA, 487 bp, Homo sapiens
  misc_feature: HIJSMM301BD9D8.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaagaactgtggctgcaccat

SEQ ID NO: 570959 - DNA, 491 bp, Homo sapiens
  misc_feature: HIJSMM301AQF4N.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactg

SEQ ID NO: 570960 - DNA, 492 bp, Homo sapiens; identical to SEQ ID NO: 558606
  misc_feature: HIJSMM301ENF4C.16.53.E09.1.454.light.4.raw

SEQ ID NO: 570961 - DNA, 377 bp, Homo sapiens; identical to SEQ ID NO: 536071
  misc_feature: HIJSMM301DW29U.40.9.A09.1.454.light.4.raw

SEQ ID NO: 570962 - DNA, 524 bp, Homo sapiens
  misc_feature: HIJSMM301CJ7VO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaaggacgaacggtaggaaggtacgaaacgaaacctaagtaggcgtgcgaccaacactgtcttctatcttccgtccactcctgat

SEQ ID NO: 570963 - DNA, 486 bp, Homo sapiens; identical to SEQ ID NO: 535917
  misc_feature: HIJSMM301DM8ME.3.10.A10.1.454.light.4.raw

SEQ ID NO: 570964 - DNA, 512 bp, Homo sapiens; identical to SEQ ID NO: 539813
  misc_feature: HIJSMM301DRZPO.14.7.A07.1.454.light.4.raw

SEQ ID NO: 570965 - DNA, 441 bp, Homo sapiens; identical to SEQ ID NO: 535074
  misc_feature: HIJSMM301BMPE9.11.3.A03.1.454.light.4.raw

SEQ ID NO: 570966 - DNA, 488 bp, Homo sapiens; identical to SEQ ID NO: 535990
  misc_feature: HIJSMM301DWEBE.11.28.C06.1.454.light.4.raw

SEQ ID NO: 570967 - DNA, 510 bp, Homo sapiens
  misc_feature: HIJSMM301ADH5R.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtaggagtatcaaacgaactagtggctgcaccatctgtctt

SEQ ID NO: 570968 - DNA, 506 bp, Homo sapiens; identical to SEQ ID NO: 544872
  misc_feature: HIJSMM301DWXA7.18.78.H01.1.454.light.4.raw

SEQ ID NO: 570969 - DNA, 500 bp, Homo sapiens
  misc_feature: HIJSMM301BG6OM.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctccacggtactacttttggccgaggggaccaagctggagatacaaacgaactgtggctgcacatctgtt

SEQ ID NO: 570970 - DNA, 434 bp, Homo sapiens; identical to SEQ ID NO: 535153
  misc_feature: HIJSMM301BES02.18.5.A05.1.454.light.4.raw

SEQ ID NO: 570971 - DNA, 497 bp, Homo sapiens
  misc_feature: HIJSMM301EV99F.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttc

SEQ ID NO: 570972 - DNA, 508 bp, Homo sapiens
  misc_feature: HIJSMM301C01JP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccaagtcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatctgtcttcatcttccccg

SEQ ID NO: 570973 - DNA, 492 bp, Homo sapiens
  misc_feature: HIJSMM301EJL3V.19.57.F02.1.454.light.4.raw
tactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccatctgtctt

SEQ ID NO: 570974 - DNA, 486 bp, Homo sapiens; identical to SEQ ID NO: 535458
  misc_feature: HIJSMM301D0PQB.7.75.G09.1.454.light.4.raw

SEQ ID NO: 570975 - DNA, 494 bp, Homo sapiens; identical to SEQ ID NO: 536974
  misc_feature: HIJSMM301CTOBK.16.86.H09.1.454.light.4.raw

SEQ ID NO: 570976 - DNA, 490 bp, Homo sapiens
  misc_feature: HIJSMM301CTVHZ.16.86.H09.1.454.light.4.raw
tgtactactccacgaccggtgctcgatttagtgctatagacttgggtttgggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgacgtcctaggtcagccaaggc

SEQ ID NO: 570977 - DNA, 512 bp, Homo sapiens; identical to SEQ ID NO: 545961
  misc_feature: HIJSMM301D5P4Y.14.78.H01.1.454.light.4.raw

SEQ ID NO: 570978 - DNA, 495 bp, Homo sapiens
  misc_feature: HIJSMM301EP4J7.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcagtgcaagctctaacaactccttactacgtttgccgaggggaccaagcgtggagactcaaacgaactgt

SEQ ID NO: 570979 - DNA, 486 bp, Homo sapiens
  misc_feature: HIJSMM301D9JTB.49.64.F09.1.454.light.4.raw
agtcgagagacacgaccggtgctcgatttagcgcgtatacaaggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagatttggaaagtactattgtcaacagagttacggaaacttagctcattttcggcggagggaccaaggtggagatcaaaagaactgtggctgcaccatctgtcttcta

SEQ ID NO: 570980 - DNA, 493 bp, Homo sapiens; identical to SEQ ID NO: 536289
  misc_feature: HIJSMM301DQXX5.14.5.A05.1.454.light.4.raw

SEQ ID NO: 570981 - DNA, 471 bp, Homo sapiens
  misc_feature: HIJSMM301BNKBH.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggctgagggaccaaggtggagatcaaacgaactgtggctgcaccat

SEQ ID NO: 570982 - DNA, 482 bp, Homo sapiens
  misc_feature: HIJSMM301EAG8J.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcgggcggagggaccaggctgaccgtcctaggtc

SEQ ID NO: 570983 - DNA, 479 bp, Homo sapiens
  misc_feature: HIJSMM301BLKKD.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaact

SEQ ID NO: 570984 - DNA, 497 bp, Homo sapiens
  misc_feature: HIJSMM301B3RRF.11.59.F04.1.454.light.4.raw
  modified_base (444)..(444): a, c, t, g, unknown or other
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactctttttcncttcggaactgggaccacggtcaccgtcctaggtcagcccaaggccaacccca

SEQ ID NO: 570985 - DNA, 466 bp, Homo sapiens; identical to SEQ ID NO: 535366
  misc_feature: HIJSMM301AQ0QU.13.4.A04.1.454.light.4.raw

SEQ ID NO: 570986 - DNA, 507 bp, Homo sapiens; identical to SEQ ID NO: 539817
  misc_feature: HIJSMM301EPWIY.5.24.C02.1.454.light.4.raw

SEQ ID NO: 570987 - DNA, 483 bp, Homo sapiens
  misc_feature: HIJSMM301EVGWR.48.12.B01.1.454.light.4.raw
agtatacatacacgaccggtgctcgatttagtagtgtagattccgcgggggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacagggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccatctgtcttcatcttcccgccat

SEQ ID NO: 570988 - DNA, 493 bp, Homo sapiens
  misc_feature: HIJSMM301AZIF1.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggaagtgggtctgggacagagttcactctcaccatcagcagcctgcagtctgaagattttgcagtttatactgtcagcagtataattactggcctcggacgttcggccaagggaccaaggtggaagtcaaacgaactgtggctgcaccatctgtcttcta

SEQ ID NO: 570989 - DNA, 491 bp, Homo sapiens; identical to SEQ ID NO: 549507
  misc_feature: HIJSMM301C0TGY.5.57.F02.1.454.light.4.raw

SEQ ID NO: 570990 - DNA, 497 bp, Homo sapiens; identical to SEQ ID NO: 535764
  misc_feature: HIJSMM301DBL7B.22.20.B09.1.454.light.4.raw

SEQ ID NO: 570991 - DNA, 483 bp, Homo sapiens
  misc_feature: HIJSMM301B3TOI.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgctaacttattactgtctacaagattacacttaccctgggacgttcggccaagggaccgaaggtggaaatacaaacgaactagtggctgcacc

SEQ ID NO: 570992 - DNA, 491 bp, Homo sapiens
  misc_feature: HIJSMM301A1CIP.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtgctgcacatctgtctt

SEQ ID NO: 570993 - DNA, 493 bp, Homo sapiens
  misc_feature: HIJSMM301AX6AX.17.67.G01.1.454.light.4.raw
cgtagactagcacgaccggtgctcgatttagagtatacatattgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggtccggagggaccgagggtagggaaagtacaaacgaaactagtggcgtgg

SEQ ID NO: 570994 - DNA, 497 bp, Homo sapiens; identical to SEQ ID NO: 545672
  misc_feature: HIJSMM301C3LVO.2.49.E05.1.454.light.4.raw

SEQ ID NO: 570995 - DNA, 494 bp, Homo sapiens; identical to SEQ ID NO: 534992
  misc_feature: HIJSMM301DQK5O.9.1.A01.1.454.light.4.raw

SEQ ID NO: 570996 - DNA, 492 bp, Homo sapiens
  misc_feature: HIJSMM301DUO1Z.51.82.H05.1.454.light.4.raw
cgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggccctcgggggtccctgaccgattctctggctccaagtctgacacttcagcctccctggccatcactgggctccagactgaggatgaggctgactattactgccagtcctatgacagcaggctgactgctgtggttttcggcggcgggaccaagctgaccgtcctaggtcacg

SEQ ID NO: 570997 - DNA, 486 bp, Homo sapiens; identical to SEQ ID NO: 544919
  misc_feature: HIJSMM301BBSEH.7.85.H08.1.454.light.4.raw

SEQ ID NO: 570998 - DNA, 480 bp, Homo sapiens; identical to SEQ ID NO: 557152
  misc_feature: HIJSMM301BEAUY.8.12.B01.1.454.light.4.raw

SEQ ID NO: 570999 - DNA, 507 bp, Homo sapiens
  misc_feature: HIJSMM301CHLL1.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccggcc

SEQ ID NO: 571000 - DNA, 502 bp, Homo sapiens; identical to SEQ ID NO: 541971
  misc_feature: HIJSMM301EPQQU.4.39.D06.1.454.light.4.raw

SEQ ID NO: 571001 - DNA, 494 bp, Homo sapiens; identical to SEQ ID NO: 540110
  misc_feature: HIJSMM301AI8CN.51.71.G05.1.454.light.4.raw

SEQ ID NO: 571002 - DNA, 479 bp, Homo sapiens
  misc_feature: HIJSMM301DF0XM.7.67.G01.1.454.light.4.raw
  modified_base (310)..(310): a, c, t, g, unknown or other
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaatccccctnatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggaggga

SEQ ID NO: 571003 - DNA, 509 bp, Homo sapiens; identical to SEQ ID NO: 563036
  misc_feature: HIJSMM301CHO9J.5.58.F03.1.454.light.4.raw

SEQ ID NO: 571004 - DNA, 491 bp, Homo sapiens; identical to SEQ ID NO: 535294
  misc_feature: HIJSMM301AMGTM.16.68.G02.1.454.light.4.raw

SEQ ID NO: 571005 - DNA, 486 bp, Homo sapiens; identical to SEQ ID NO: 536323
  misc_feature: HIJSMM301A48TZ.10.2.A02.1.454.light.4.raw

SEQ ID NO: 571006 - DNA, 496 bp, Homo sapiens; identical to SEQ ID NO: 548177
  misc_feature: HIJSMM301AJM1F.18.59.F04.1.454.light.4.raw

SEQ ID NO: 571007 - DNA, 494 bp, Homo sapiens; identical to SEQ ID NO: 535828
  misc_feature: HIJSMM301AJ3TB.3.36.D03.1.454.light.4.raw

SEQ ID NO: 571008 - DNA, 447 bp, Homo sapiens; identical to SEQ ID NO: 535020
  misc_feature: HIJSMM301DIJJQ.18.9.A09.1.454.light.4.raw

SEQ ID NO: 571009 - DNA, 497 bp, Homo sapiens; identical to SEQ ID NO: 536371
  misc_feature: HIJSMM301C1BI9.16.78.H01.1.454.light.4.raw

SEQ ID NO: 571010 - DNA, 495 bp, Homo sapiens
  misc_feature: HIJSMM301BZM8U.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacttcggccaagggaccaaggtggaaatcaaacgaactgtggctgcacc

SEQ ID NO: 571011 - DNA, 510 bp, Homo sapiens
  misc_feature: HIJSMM301DB7DA.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccgagggtggaaagtacaggaacgaacgtgtgggctgcaccat

SEQ ID NO: 571012 - DNA, 493 bp, Homo sapiens
  misc_feature: HIJSMM301D9LDZ.27.78.H01.1.454.light.4.raw
  modified_base (461)..(461): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactgganattaaacgaactgtggctgcaccatctgtctt

SEQ ID NO: 571013 - DNA, 521 bp, Homo sapiens
  misc_feature: HIJSMM301B64AY.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccaccct

SEQ ID NO: 571014 - DNA, 498 bp, Homo sapiens
  misc_feature: HIJSMM301CDVCL.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaagtacaaacgaactagtggctgcaccatctgtcttcatt

SEQ ID NO: 571015 - DNA, 483 bp, Homo sapiens; identical to SEQ ID NO: 539848
  misc_feature: HIJSMM301BYWFA.46.26.C04.1.454.light.4.raw

SEQ ID NO: 571016 - DNA, 524 bp, Homo sapiens
  misc_feature: HIJSMM301D3WYB.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcaggtagggtcgggagccggggatggagggcgactattactgtcaggtgtgggatcacactagtgatcattatgtcttcgggactcgggggaccgaggtcaccggtcctaggtccagccccaaggcccaaccccactcgtcactctcgttccccta

SEQ ID NO: 571017 - DNA, 520 bp, Homo sapiens
  misc_feature: HIJSMM301CSPRQ.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtccactctgttcccgccctcctccacg

SEQ ID NO: 571018 - DNA, 505 bp, Homo sapiens
  misc_feature: HIJSMM301BFFD7.8.28.C06.1.454.light.4.raw
ctcgcgtgtccacgaccggtgctcgatttagagctcacgtattgggtttgggggaggaactgctcagttaggacccagacgggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgc

SEQ ID NO: 571019 - DNA, 481 bp, Homo sapiens
  misc_feature: HIJSMM301AGQOF.51.61.F06.1.454.light.4.raw
cgatcgtatacacgaccggtgctcgatttagctacgctctaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcacttcggcggagggaccaaggtggagatcaaacgaactgtggctgcacc

SEQ ID NO: 571020 - DNA, 422 bp, Homo sapiens; identical to SEQ ID NO: 447881
  misc_feature: HIJSMM301EUZV2.9.34.D01.1.454.light.4.raw

SEQ ID NO: 571021 - DNA, 454 bp, Homo sapiens; identical to SEQ ID NO: 534964
  misc_feature: HIJSMM301EUCOO.19.86.H09.1.454.light.4.raw

SEQ ID NO: 571022 - DNA, 503 bp, Homo sapiens
  misc_feature: HIJSMM301D5UD9.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagccaaggctgccccctcggtcac

SEQ ID NO: 571023 - DNA, 457 bp, Homo sapiens; identical to SEQ ID NO: 542093
  misc_feature: HIJSMM301ER6DJ.13.23.C01.1.454.light.4.raw

SEQ ID NO: 571024 - DNA, 416 bp, Homo sapiens; identical to SEQ ID NO: 545902
  misc_feature: HIJSMM301C8LKS.18.78.H01.1.454.light.4.raw

SEQ ID NO: 571025 - DNA, 486 bp, Homo sapiens; identical to SEQ ID NO: 535290
  misc_feature: HIJSMM301ALVMQ.3.12.B01.1.454.light.4.raw

SEQ ID NO: 571026 - DNA, 521 bp, Homo sapiens
  misc_feature: HIJSMM301ESPVF.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtccaggccccaaggccaaccccactgtcactctcg

SEQ ID NO: 571027 - DNA, 481 bp, Homo sapiens
  misc_feature: HIJSMM301BREO3.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaactcgtacacttttggccaggggaccaggctggagatcaaacgaactgtggctgcaccatctgtt

SEQ ID NO: 571028 - DNA, 506 bp, Homo sapiens; identical to SEQ ID NO: 538849
  misc_feature: HIJSMM301AUXBJ.43.15.B04.1.454.light.4.raw

SEQ ID NO: 571029 - DNA, 488 bp, Homo sapiens
  misc_feature: HIJSMM301BDBJD.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctacc

SEQ ID NO: 571030 - DNA, 497 bp, Homo sapiens
  misc_feature: HIJSMM301A6L4S.4.59.F04.1.454.light.4.raw
  modified_base (482)..(482): a, c, t, g, unknown or other
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctcgtggacgtcgccgaacggaccgaaggtaggaatacaaacgaactagtggntgcaccatctgtctt

SEQ ID NO: 571031 - DNA, 486 bp, Homo sapiens; identical to SEQ ID NO: 535385
  misc_feature: HIJSMM301DACH0.19.71.G05.1.454.light.4.raw

SEQ ID NO: 571032 - DNA, 504 bp, Homo sapiens; identical to SEQ ID NO: 560731
  misc_feature: HIJSMM301D34PX.5.24.C02.1.454.light.4.raw

SEQ ID NO: 571033 - DNA, 468 bp, Homo sapiens; identical to SEQ ID NO: 535969
  misc_feature: HIJSMM301BNW9O.3.82.H05.1.454.light.4.raw

SEQ ID NO: 571034 - DNA, 516 bp, Homo sapiens; identical to SEQ ID NO: 538293
  misc_feature: HIJSMM301BHQ58.14.19.B08.1.454.light.4.raw

SEQ ID NO: 571035 - DNA, 494 bp, Homo sapiens; identical to SEQ ID NO: 534992
  misc_feature: HIJSMM301C88VC.9.1.A01.1.454.light.4.raw

SEQ ID NO: 571036 - DNA, 447 bp, Homo sapiens; identical to SEQ ID NO: 535201
  misc_feature: HIJSMM301B0MCU.18.9.A09.1.454.light.4.raw

SEQ ID NO: 571037 - DNA, 501 bp, Homo sapiens; identical to SEQ ID NO: 569393
  misc_feature: HIJSMM301A0XGQ.16.86.H09.1.454.light.4.raw

SEQ ID NO: 571038 - DNA, 454 bp, Homo sapiens; identical to SEQ ID NO: 534964
  misc_feature: HIJSMM301C21QZ.19.86.H09.1.454.light.4.raw

SEQ ID NO: 571039 - DNA, 489 bp, Homo sapiens
  misc_feature: HIJSMM301DA6B9.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggtccaaggaccaagctggagatcaacgaactgtggctgcaccta

SEQ ID NO: 571040 - DNA, 483 bp, Homo sapiens; identical to SEQ ID NO: 535413
  misc_feature: HIJSMM301A9747.26.78.H01.1.454.light.4.raw

SEQ ID NO: 571041 - DNA, 513 bp, Homo sapiens; identical to SEQ ID NO: 540462
  misc_feature: HIJSMM301ETS5I.47.85.H08.1.454.light.4.raw

SEQ ID NO: 571042 - DNA, 447 bp, Homo sapiens; identical to SEQ ID NO: 535020
  misc_feature: HIJSMM301CNWQ2.18.9.A09.1.454.light.4.raw

SEQ ID NO: 571043 - DNA, 486 bp, Homo sapiens
  misc_feature: HIJSMM301EGUVD.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaaactagtggctgcaccatct

SEQ ID NO: 571044 - DNA, 475 bp, Homo sapiens
  misc_feature: HIJSMM301C6WPR.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttacctcttttcggcctgggaccaaagtggatatcaaacgaactagtggctgcacc

SEQ ID NO: 571045 - DNA, 441 bp, Homo sapiens; identical to SEQ ID NO: 534971
  misc_feature: HIJSMM301EX8PF.11.3.A03.1.454.light.4.raw

SEQ ID NO: 571046 - DNA, 493 bp, Homo sapiens
  misc_feature: HIJSMM301EGR1X.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagaattaaacgaactgtggctgcaccatctgtcttcatcc

SEQ ID NO: 571047 - DNA, 490 bp, Homo sapiens; identical to SEQ ID NO: 535526
  misc_feature: HIJSMM301ARC0K.26.78.H01.1.454.light.4.raw

SEQ ID NO: 571048 - DNA, 492 bp, Homo sapiens; identical to SEQ ID NO: 537666
  misc_feature: HIJSMM301BDZTF.43.33.C11.1.454.light.4.raw

SEQ ID NO: 571049 - DNA, 464 bp, Homo sapiens; identical to SEQ ID NO: 536640
  misc_feature: HIJSMM301EAZC2.26.78.H01.1.454.light.4.raw

SEQ ID NO: 571050 - DNA, 493 bp, Homo sapiens; identical to SEQ ID NO: 540418
  misc_feature: HIJSMM301B78OM.26.72.G06.1.454.light.4.raw

SEQ ID NO: 571051 - DNA, 488 bp, Homo sapiens; identical to SEQ ID NO: 537124
  misc_feature: HIJSMM301ATRDU.11.25.C03.1.454.light.4.raw

SEQ ID NO: 571052 - DNA, 445 bp, Homo sapiens; identical to SEQ ID NO: 537719
  misc_feature: HIJSMM301C44IJ.47.85.H08.1.454.light.4.raw

SEQ ID NO: 571053 - DNA, 505 bp, Homo sapiens
  misc_feature: HIJSMM301EUFLP.40.28.C06.1.454.light.4.raw
  modified_base (434)..(434): a, c, t, g, unknown or other
tctagcgactcacgaccggtgctcgatttagagctcacgtattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctnacgttcggcggagggaccaaggtggacatcaaacgaactgtggctgcaccatctgtcttcatcttcccgcc

SEQ ID NO: 571054 - DNA, 486 bp, Homo sapiens
  misc_feature: HIJSMM301CF9WR.47.70.G04.1.454.light.4.raw
  modified_base (469)..(469): a, c, t, g, unknown or other
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaacngtggctgcaccatctgt

SEQ ID NO: 571055 - DNA, 500 bp, Homo sapiens; identical to SEQ ID NO: 546613
  misc_feature: HIJSMM301A71TG.11.21.B10.1.454.light.4.raw

SEQ ID NO: 571056 - DNA, 447 bp, Homo sapiens; identical to SEQ ID NO: 535020
  misc_feature: HIJSMM301EIRNF.18.9.A09.1.454.light.4.raw

SEQ ID NO: 571057 - DNA, 444 bp, Homo sapiens; identical to SEQ ID NO: 535856
  misc_feature: HIJSMM301DXLA6.9.9.A09.1.454.light.4.raw

SEQ ID NO: 571058 - DNA, 503 bp, Homo sapiens; identical to SEQ ID NO: 538798
  misc_feature: HIJSMM301D8J27.14.86.H09.1.454.light.4.raw

SEQ ID NO: 571059 - DNA, 509 bp, Homo sapiens
  misc_feature: HIJSMM301CR9L1.53.71.G05.1.454.light.4.raw
cgcgtatacacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagttgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctcgccccctcggtcactctgtt

SEQ ID NO: 571060 - DNA, 489 bp, Homo sapiens
  misc_feature: HIJSMM301DC9J5.52.53.E09.1.454.light.4.raw
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgaggggggacggtatccctgatcgcttctcaggctccggctctgggactgagcgctacctcaccatctccagcctccagtctgaggacgagggtgactattactgtcagacgtgggacactggctatttggggtgttcgggcggagggaccaaggttgaccgtctaggtcagcccaaggctccg

SEQ ID NO: 571061 - DNA, 486 bp, Homo sapiens; identical to SEQ ID NO: 535385
  misc_feature: HIJSMM301AY5RP.19.71.G05.1.454.light.4.raw

SEQ ID NO: 571062 - DNA, 502 bp, Homo sapiens; identical to SEQ ID NO: 558110
  misc_feature: HIJSMM301DHCXZ.4.6.A06.1.454.light.4.raw

SEQ ID NO: 571063 - DNA, 518 bp, Homo sapiens
  misc_feature: HIJSMM301BLKYY.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgagggacgaggctcattactactgctgctcatatggagggttatagcacttgggtgttcggcggcgggaccaaagtgacgtcctaagtcagcccaaggctgccccctcggtcactctgttccc

SEQ ID NO: 571064 - DNA, 466 bp, Homo sapiens; identical to SEQ ID NO: 536398
  misc_feature: HIJSMM301EUO44.3.20.B09.1.454.light.4.raw

SEQ ID NO: 571065 - DNA, 518 bp, Homo sapiens; identical to SEQ ID NO: 539372
  misc_feature: HIJSMM301BJC05.7.86.H09.1.454.light.4.raw

SEQ ID NO: 571066 - DNA, 493 bp, Homo sapiens
  misc_feature: HIJSMM301BCBHD.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggatatcagacgaactgtggctgca

SEQ ID NO: 571067 - DNA, 514 bp, Homo sapiens
  misc_feature: HIJSMM301A5T67.40.12.B01.1.454.light.4.raw
tctagcgactcacgaccggtgctcgatttagtagtgtagattccgcgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccg

SEQ ID NO: 571068 - DNA, 504 bp, Homo sapiens; identical to SEQ ID NO: 549053
  misc_feature: HIJSMM301DSK0X.4.71.G05.1.454.light.4.raw

SEQ ID NO: 571069 - DNA, 497 bp, Homo sapiens
  misc_feature: HIJSMM301A63ZF.52.38.D05.1.454.light.4.raw
cgcagtacgacacgaccggtgctcgatttagtatctgatagttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 571070 - DNA, 513 bp, Homo sapiens; identical to SEQ ID NO: 541387
  misc_feature: HIJSMM301B3E5N.17.33.C11.1.454.light.4.raw

SEQ ID NO: 571071 - DNA, 481 bp, Homo sapiens
  misc_feature: HIJSMM301AL2TN.13.59.F04.1.454.light.4.raw
tcacgtactacacgaccggtgctcgatttagtacacacacttagggattgggggcagaagtctctctcagtcaggacacagcatggacatgagggtccctgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtaggaaagtcaaacgaactagtgg

SEQ ID NO: 571072 - DNA, 514 bp, Homo sapiens
  misc_feature: HIJSMM301DFKYN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctggtcactctgttcccgcctcctcc

SEQ ID NO: 571073 - DNA, 487 bp, Homo sapiens; identical to SEQ ID NO: 536025
  misc_feature: HIJSMM301C7O21.17.34.D01.1.454.light.4.raw

SEQ ID NO: 571074 - DNA, 498 bp, Homo sapiens; identical to SEQ ID NO: 558678
  misc_feature: HIJSMM301D4W40.48.87.H10.1.454.light.4.raw

SEQ ID NO: 571075 - DNA, 510 bp, Homo sapiens; identical to SEQ ID NO: 556652
  misc_feature: HIJSMM301CY8OM.17.28.C06.1.454.light.4.raw

SEQ ID NO: 571076 - DNA, 502 bp, Homo sapiens; identical to SEQ ID NO: 538897
  misc_feature: HIJSMM301BCRM5.21.38.D05.1.454.light.4.raw

SEQ ID NO: 571077 - DNA, 493 bp, Homo sapiens
  misc_feature: HIJSMM301CDTW9.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtgctgcaccat

SEQ ID NO: 571078 - DNA, 488 bp, Homo sapiens
  misc_feature: HIJSMM301DICBU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcaccatctgtcttc

SEQ ID NO: 571079 - DNA, 523 bp, Homo sapiens
  misc_feature: HIJSMM301CQMML.53.77.G11.1.454.light.4.raw
cgcgtatacacacgaccggtgctcgatttagctagtcactcaagggaaaggggggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccaccctcctctcgta

SEQ ID NO: 571080 - DNA, 498 bp, Homo sapiens
  misc_feature: HIJSMM301A295H.43.62.F07.1.454.light.4.raw
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactgtggctgcaccatctgtcttcta

SEQ ID NO: 571081 - DNA, 361 bp, Homo sapiens; identical to SEQ ID NO: 540413
  misc_feature: HIJSMM301EQ0XP.3.57.F02.1.454.light.4.raw

SEQ ID NO: 571082 - DNA, 498 bp, Homo sapiens; identical to SEQ ID NO: 555873
  misc_feature: HIJSMM301CBCHO.3.71.G05.1.454.light.4.raw

SEQ ID NO: 571083 - DNA, 516 bp, Homo sapiens
  misc_feature: HIJSMM301A2S4R.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaaggacccggtggaaataaaacgaactagtggctgcaccatctgtcttcatcttccccg

SEQ ID NO: 571084 - DNA, 496 bp, Homo sapiens
  misc_feature: HIJSMM301CD0FC.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactggaccaaggtcaccgtctaggtcagccaggccaaccc

SEQ ID NO: 571085 - DNA, 497 bp, Homo sapiens
  misc_feature: HIJSMM301CPNNJ.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagccc

SEQ ID NO: 571086 - DNA, 490 bp, Homo sapiens
  misc_feature: HIJSMM301CH3SW.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggtttagttactgcatgcaagctctacaaactccttacacttttggccaggggaccaagctggagatcaaacgaactgt

SEQ ID NO: 571087 - DNA, 501 bp, Homo sapiens; identical to SEQ ID NO: 568432
  misc_feature: HIJSMM301EGLOI.2.49.E05.1.454.light.4.raw

SEQ ID NO: 571088 - DNA, 501 bp, Homo sapiens
  misc_feature: HIJSMM301AV4KS.13.39.D06.1.454.light.4.raw
tcacgtactacacgaccggtgctcgatttagtgacatctcgcagttctttggggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctc

SEQ ID NO: 571089 - DNA, 492 bp, Homo sapiens; identical to SEQ ID NO: 567691
  misc_feature: HIJSMM301D9LDL.10.5.A05.1.454.light.4.raw

SEQ ID NO: 571090 - DNA, 502 bp, Homo sapiens; identical to SEQ ID NO: 537816
  misc_feature: HIJSMM301B7HJN.19.78.H01.1.454.light.4.raw

SEQ ID NO: 571091 - DNA, 484 bp, Homo sapiens; identical to SEQ ID NO: 535400
  misc_feature: HIJSMM301EM7VY.46.26.C04.1.454.light.4.raw

SEQ ID NO: 571092 - DNA, 489 bp, Homo sapiens; identical to SEQ ID NO: 535139
  misc_feature: HIJSMM301DXKXK.14.55.E11.1.454.light.4.raw

SEQ ID NO: 571093 - DNA, 515 bp, Homo sapiens; identical to SEQ ID NO: 538805
  misc_feature: HIJSMM301CVRLT.14.19.B08.1.454.light.4.raw

SEQ ID NO: 571094 - DNA, 517 bp, Homo sapiens; identical to SEQ ID NO: 564566
  misc_feature: HIJSMM301DZ9RX.14.66.F11.1.454.light.4.raw

SEQ ID NO: 571095 - DNA, 512 bp, Homo sapiens
  misc_feature: HIJSMM301A4WPR.40.47.E03.1.454.light.4.raw
tctagcgactcacgaccggtgctcgatttagactcgcgcacagagagaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcggggggaccgaagctgaccgtcctaggtcagcccaagctgcccctcggtcactctcg

SEQ ID NO: 571096 - DNA, 485 bp, Homo sapiens; identical to SEQ ID NO: 535880
  misc_feature: HIJSMM301CB1FY.7.75.G09.1.454.light.4.raw

SEQ ID NO: 571097 - DNA, 510 bp, Homo sapiens
  misc_feature: HIJSMM301E2V4V.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtgctgcaccatctgtcttcatcttcccgccatt

SEQ ID NO: 571098 - DNA, 506 bp, Homo sapiens; identical to SEQ ID NO: 534969
  misc_feature: HIJSMM301AJTGR.18.37.D04.1.454.light.4.raw

SEQ ID NO: 571099 - DNA, 493 bp, Homo sapiens; identical to SEQ ID NO: 563110
  misc_feature: HIJSMM301B0YBQ.16.6.A06.1.454.light.4.raw

SEQ ID NO: 571100 - DNA, 485 bp, Homo sapiens; identical to SEQ ID NO: 535688
  misc_feature: HIJSMM301ENMI3.19.5.A05.1.454.light.4.raw

SEQ ID NO: 571101 - DNA, 488 bp, Homo sapiens
  misc_feature: HIJSMM301DV4EH.49.73.G07.1.454.light.4.raw
agtcgagagacacgaccggtgctcgatttagctctacgctcagggcacgaccggtgctcgatttagagtgctacgaagggaaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggact

SEQ ID NO: 571102 - DNA, 498 bp, Homo sapiens
  misc_feature: HIJSMM301AYURN.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtcctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaac

SEQ ID NO: 571103 - DNA, 485 bp, Homo sapiens; identical to SEQ ID NO: 536576
  misc_feature: HIJSMM301CQZDW.46.35.D02.1.454.light.4.raw

SEQ ID NO: 571104 - DNA, 495 bp, Homo sapiens
  misc_feature: HIJSMM301DCRS5.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagtcgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgaggtgactattactgtcagtctcgcaaacaccactgcagcggtgttcgcggaggaccaagctgaccgtcctgcgtcagcccaaggctgccccctcggtccactctgttcccta

SEQ ID NO: 571105 - DNA, 485 bp, Homo sapiens
  misc_feature: HIJSMM301CZ3QD.5.39.D06.1.454.light.4.raw
atcagacacgcacgaccggtgctcgatttagtgacatctcgcagttctttgggcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcccaccaacgttcagcggcagtggatctgggacagagttcactctcaccatcagcagcctgcagcctgatgatcttggaacttattactgccaacaatataatagttattggacgttcggccac

SEQ ID NO: 571106 - DNA, 508 bp, Homo sapiens; identical to SEQ ID NO: 560800
  misc_feature: HIJSMM301ALBGC.17.33.C11.1.454.light.4.raw

SEQ ID NO: 571107 - DNA, 492 bp, Homo sapiens; identical to SEQ ID NO: 535126
  misc_feature: HIJSMM301D49KO.18.11.A11.1.454.light.4.raw

SEQ ID NO: 571108 - DNA, 501 bp, Homo sapiens; identical to SEQ ID NO: 535746
  misc_feature: HIJSMM301BUD5Q.18.11.A11.1.454.light.4.raw

SEQ ID NO: 571109 - DNA, 496 bp, Homo sapiens
  misc_feature: HIJSMM301AV4SS.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccgaacgggaccgaacggtaggaaagtactaaacgaactagtggcgtgcgaccta

SEQ ID NO: 571110 - DNA, 505 bp, Homo sapiens; identical to SEQ ID NO: 546621
  misc_feature: HIJSMM301DLNO4.15.86.H09.1.454.light.4.raw

SEQ ID NO: 571111 - DNA, 513 bp, Homo sapiens
  misc_feature: HIJSMM301CVAVP.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcccggaccctgcccgattctcaggctccctccttgggggcaaagctgccctgacactgtctggtgtgcagcctgaggacgaggctgactattactgcctactctactttggtggtgctgtgctattcggcggaggaccaagctgaccgtcttaagtcagcccaaggctgccccctggtcactctcgttcccacctcctcct

SEQ ID NO: 571112 - DNA, 495 bp, Homo sapiens; identical to SEQ ID NO: 535596
  misc_feature: HIJSMM301DRY1F.10.79.H02.1.454.light.4.raw

SEQ ID NO: 571113 - DNA, 495 bp, Homo sapiens; identical to SEQ ID NO: 566263
  misc_feature: HIJSMM301CC6VU.51.35.D02.1.454.light.4.raw

SEQ ID NO: 571114 - DNA, 518 bp, Homo sapiens
  misc_feature: HIJSMM301EF4GN.48.38.D05.1.454.light.4.raw
agtatacatacacgaccggtgctcgatttagtatctgatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgaggtgattttattgtgctgtttgggatgacgacatgaatggttcgattttcggcggagggaccaaactgaccgtcctgggtcagcccaaggctgccccctcggtcactctgttcccgccctcctcta

SEQ ID NO: 571115 - DNA, 507 bp, Homo sapiens; identical to SEQ ID NO: 538702
  misc_feature: HIJSMM301DOO5B.11.57.F02.1.454.light.4.raw

SEQ ID NO: 571116 - DNA, 485 bp, Homo sapiens; identical to SEQ ID NO: 535501
  misc_feature: HIJSMM301DCK6G.3.10.A10.1.454.light.4.raw

SEQ ID NO: 571117 - DNA, 485 bp, Homo sapiens; identical to SEQ ID NO: 536040
  misc_feature: HIJSMM301B86GS.15.1.A01.1.454.light.4.raw

SEQ ID NO: 571118 - DNA, 486 bp, Homo sapiens; identical to SEQ ID NO: 535385
  misc_feature: HIJSMM301AJY3P.19.71.G05.1.454.light.4.raw

SEQ ID NO: 571119 - DNA, 488 bp, Homo sapiens; identical to SEQ ID NO: 537673
  misc_feature: HIJSMM301A0W76.12.31.C09.1.454.light.4.raw

SEQ ID NO: 571120 - DNA, 510 bp, Homo sapiens; identical to SEQ ID NO: 556652
  misc_feature: HIJSMM301BZVIY.17.28.C06.1.454.light.4.raw

SEQ ID NO: 571121 - DNA, 454 bp, Homo sapiens; identical to SEQ ID NO: 536943
  misc_feature: HIJSMM301CUS9U.19.86.H09.1.454.light.4.raw

SEQ ID NO: 571122 - DNA, 505 bp, Homo sapiens
  misc_feature: HIJSMM301EFZU0.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 571123 - DNA, 487 bp, Homo sapiens
  misc_feature: HIJSMM301B7BR1.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagattttcactctcaccatcagcagcctgcagcctgaagattttgcaacttattactgtctacaagattacaattaccctcgaacgttcggccaaggaccgaaggtaggaaggtcaaaacgaactagtggcgtgcaccat

SEQ ID NO: 571124 - DNA, 480 bp, Homo sapiens
  misc_feature: HIJSMM301DZO7P.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtgg

SEQ ID NO: 571125 - DNA, 491 bp, Homo sapiens
  misc_feature: HIJSMM301DEUHK.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtcaagggaccaaagtggacatcaagcgaactgttgctgcaccatctgtt

SEQ ID NO: 571126 - DNA, 496 bp, Homo sapiens
  misc_feature: HIJSMM301ELQQC.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcaggcccaa

SEQ ID NO: 571127 - DNA, 484 bp, Homo sapiens; identical to SEQ ID NO: 535400
  misc_feature: HIJSMM301AN393.46.26.C04.1.454.light.4.raw

SEQ ID NO: 571128 - DNA, 489 bp, Homo sapiens; identical to SEQ ID NO: 535139
  misc_feature: HIJSMM301CP5TC.14.55.E11.1.454.light.4.raw

SEQ ID NO: 571129 - DNA, 517 bp, Homo sapiens
  misc_feature: HIJSMM301D88J4.7.86.H09.1.454.light.4.raw
  modified_base (475)..(475): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagttttactactgtcagcagtatgttaccgtccccgtggacgttcggccaagggaccaaggnggcaatcaacgaactgtggctgcaccatctgtcttcatcctt

SEQ ID NO: 571130 - DNA, 460 bp, Homo sapiens; identical to SEQ ID NO: 536053
  misc_feature: HIJSMM301DR61L.22.28.C06.1.454.light.4.raw

SEQ ID NO: 571131 - DNA, 490 bp, Homo sapiens; identical to SEQ ID NO: 541567
  misc_feature: HIJSMM301EI0TM.22.65.F10.1.454.light.4.raw

SEQ ID NO: 571132 - DNA, 502 bp, Homo sapiens
  misc_feature: HIJSMM301BZG7M.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagccaaggccaacccactgtca

SEQ ID NO: 571133 - DNA, 494 bp, Homo sapiens
  misc_feature: HIJSMM301AGPWR.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactagtggctgcaccatctgtcttcatcttcccg

SEQ ID NO: 571134 - DNA, 493 bp, Homo sapiens
  misc_feature: HIJSMM301BMPVR.49.33.C11.1.454.light.4.raw
agtcgagagacacgaccggtgctcgatttagagtgagctcgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctggggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 571135 - DNA, 505 bp, Homo sapiens
  misc_feature: HIJSMM301CQPSP.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaattggtcatctatgaagacgacaaacgaccctccgggatccctgagagattctctggctccagctcagggactatggccaccttgactatcagtgggcccaagtggaggatgaagctgacttactactgttactcaatagagaacagtgataatttctgggtgttcggcggagggaccaaacgtgaccgtcctaggtcagcccaaggctcgccccctcggtcactctgtt

SEQ ID NO: 571136 - DNA, 484 bp, Homo sapiens; identical to SEQ ID NO: 535211
  misc_feature: HIJSMM301D1I74.47.46.E02.1.454.light.4.raw

SEQ ID NO: 571137 - DNA, 511 bp, Homo sapiens
  misc_feature: HIJSMM301APIE1.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcatggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccaccct

SEQ ID NO: 571138 - DNA, 509 bp, Homo sapiens
  misc_feature: HIJSMM301A8KRM.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccta

SEQ ID NO: 571139 - DNA, 504 bp, Homo sapiens; identical to SEQ ID NO: 538681
  misc_feature: HIJSMM301EVASL.7.71.G05.1.454.light.4.raw

SEQ ID NO: 571140 - DNA, 504 bp, Homo sapiens; identical to SEQ ID NO: 538423
  misc_feature: HIJSMM301EQJVK.48.67.G01.1.454.light.4.raw

SEQ ID NO: 571141 - DNA, 514 bp, Homo sapiens
  misc_feature: HIJSMM301B1LGB.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcg

SEQ ID NO: 571142 - DNA, 484 bp, Homo sapiens; identical to SEQ ID NO: 535400
  misc_feature: HIJSMM301EL5JY.46.26.C04.1.454.light.4.raw

SEQ ID NO: 571143 - DNA, 503 bp, Homo sapiens
  misc_feature: HIJSMM301A4D9C.19.71.G05.1.454.light.4.raw
tactctcgtgcacgaccggtgctcgatttagtgtcgtcgcaagagagaggggggaggtacaacaggcaggcaggggcagcaagaatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcgtccgaacggaccgaacgtggagtatactagacgaactagtggtctcg

SEQ ID NO: 571144 - DNA, 485 bp, Homo sapiens; identical to SEQ ID NO: 550102
  misc_feature: HIJSMM301D593A.41.50.E06.1.454.light.4.raw

SEQ ID NO: 571145 - DNA, 453 bp, Homo sapiens; identical to SEQ ID NO: 535173
  misc_feature: HIJSMM301AKVPK.19.86.H09.1.454.light.4.raw

SEQ ID NO: 571146 - DNA, 510 bp, Homo sapiens
  misc_feature: HIJSMM301A1A7M.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccgaaagtaggaaatacaaacgaactgtggctgcaccatctgtcttcatcttcccgcc

SEQ ID NO: 571147 - DNA, 468 bp, Homo sapiens
  misc_feature: HIJSMM301CCXK6.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagatattgcaacatattactgtcaacagtatgatagtctcccgctcactttcggcggggggaccgaaggtggagatcaagcgaa

SEQ ID NO: 571148 - DNA, 488 bp, Homo sapiens; identical to SEQ ID NO: 537260
  misc_feature: HIJSMM301ETI4I.47.70.G04.1.454.light.4.raw

SEQ ID NO: 571149 - DNA, 441 bp, Homo sapiens; identical to SEQ ID NO: 535074
  misc_feature: HIJSMM301ALIDW.11.3.A03.1.454.light.4.raw

SEQ ID NO: 571150 - DNA, 503 bp, Homo sapiens
  misc_feature: HIJSMM301ALXZY.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggcctgccccctcggtcac

SEQ ID NO: 571151 - DNA, 518 bp, Homo sapiens
  misc_feature: HIJSMM301A7URB.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctcgttcccgccctcctcacta

SEQ ID NO: 571152 - DNA, 491 bp, Homo sapiens
  misc_feature: HIJSMM301E1O6Y.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaataggatgttcggtcggagggaccgaacggactgaccgtcctacggttc

SEQ ID NO: 571153 - DNA, 496 bp, Homo sapiens
  misc_feature: HIJSMM301AR0JH.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccgaagggacacgactggagattaaacgaactagtggctgcaccatctgtctt

SEQ ID NO: 571154 - DNA, 514 bp, Homo sapiens
  misc_feature: HIJSMM301A4LX9.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttcccgccct

SEQ ID NO: 571155 - DNA, 472 bp, Homo sapiens
  misc_feature: HIJSMM301DISU1.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctccgagtgccacgttttggcggggggaccaaggtggacatcaaacgaa

SEQ ID NO: 571156 - DNA, 498 bp, Homo sapiens
  misc_feature: HIJSMM301APAHI.43.28.C06.1.454.light.4.raw
tgtgagtagtcacgaccggtgctcgatttagagctcacgtattgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccaatcaccttcggccaagggacgacgactggagattaaccgaactgtggctgcaccatctgtcttcat

SEQ ID NO: 571157 - DNA, 505 bp, Homo sapiens; identical to SEQ ID NO: 542781
  misc_feature: HIJSMM301CVEUS.4.57.F02.1.454.light.4.raw

SEQ ID NO: 571158 - DNA, 522 bp, Homo sapiens
  misc_feature: HIJSMM301DBAH3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 571159 - DNA, 493 bp, Homo sapiens; identical to SEQ ID NO: 535047
  misc_feature: HIJSMM301EO7VB.16.53.E09.1.454.light.4.raw

SEQ ID NO: 571160 - DNA, 504 bp, Homo sapiens
  misc_feature: HIJSMM301AOX9M.51.35.D02.1.454.light.4.raw
cgatcgtatacacgaccggtgctcgatttagcacacgatagttgggtttggggtgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctcggtcactctcg

SEQ ID NO: 571161 - DNA, 506 bp, Homo sapiens; identical to SEQ ID NO: 539926
  misc_feature: HIJSMM301D6UXY.5.24.C02.1.454.light.4.raw

SEQ ID NO: 571162 - DNA, 496 bp, Homo sapiens; identical to SEQ ID NO: 542070
  misc_feature: HIJSMM301BJV1X.22.14.B03.1.454.light.4.raw

SEQ ID NO: 571163 - DNA, 503 bp, Homo sapiens; identical to SEQ ID NO: 538884
  misc_feature: HIJSMM301DXDMN.27.78.H01.1.454.light.4.raw

SEQ ID NO: 571164 - DNA, 457 bp, Homo sapiens
  misc_feature: HIJSMM301AMAFC.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctctggcgagaggtctggtgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 571165 - DNA, 520 bp, Homo sapiens
  misc_feature: HIJSMM301EC3XJ.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaatacccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 571166 - DNA, 503 bp, Homo sapiens; identical to SEQ ID NO: 543299
  misc_feature: HIJSMM301CZLGK.48.36.D03.1.454.light.4.raw

SEQ ID NO: 571167 - DNA, 494 bp, Homo sapiens
  misc_feature: HIJSMM301DD9DQ.16.6.A06.1.454.light.4.raw
  modified_base (472)..(472): a, c, t, g, unknown or other
tgtactactccacgaccggtgctcgatttagatctactgacagggggaggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatctggggtccctgaccgattcagttggcagcgggtctgggacagatttcactctcaccatcagcagcctgcaggttgaagatgtggcagtttattactgtcagcagtattatactctcctctgacgtttcggccaagggaccaaggtggagntcaaacgaactgtggctgcacc

SEQ ID NO: 571168 - DNA, 489 bp, Homo sapiens; identical to SEQ ID NO: 558406
  misc_feature: HIJSMM301D0U2Q.19.15.B04.1.454.light.4.raw

SEQ ID NO: 571169 - DNA, 494 bp, Homo sapiens
  misc_feature: HIJSMM301A8HK3.48.73.G07.1.454.light.4.raw
agtatacatacacgaccggtgctcgatttagctctacgctcagggcacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcggggggaccgaggcgtgaccgtc

SEQ ID NO: 571170 - DNA, 480 bp, Homo sapiens; identical to SEQ ID NO: 535291
  misc_feature: HIJSMM301DB5DO.22.59.F04.1.454.light.4.raw

SEQ ID NO: 571171 - DNA, 503 bp, Homo sapiens
  misc_feature: HIJSMM301BG0QR.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtccctgcgtcagccccaaggctgccccctcggtcact

SEQ ID NO: 571172 - DNA, 492 bp, Homo sapiens; identical to SEQ ID NO: 536733
  misc_feature: HIJSMM301C8EM1.40.11.A11.1.454.light.4.raw

SEQ ID NO: 571173 - DNA, 466 bp, Homo sapiens; identical to SEQ ID NO: 552352
  misc_feature: HIJSMM301A2C80.40.76.G10.1.454.light.4.raw

SEQ ID NO: 571174 - DNA, 512 bp, Homo sapiens
  misc_feature: HIJSMM301B27M6.51.35.D02.1.454.light.4.raw
cgatcgtatacacgaccggtgctcgatttagcacacgatagttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaagtacaaacgaactagtggctgcaccatctgtcttt

SEQ ID NO: 571175 - DNA, 478 bp, Homo sapiens
  misc_feature: HIJSMM301EZ29K.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgaggtctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 571176 - DNA, 489 bp, Homo sapiens; identical to SEQ ID NO: 540655
  misc_feature: HIJSMM301BWHZ4.22.87.H10.1.454.light.4.raw

SEQ ID NO: 571177 - DNA, 483 bp, Homo sapiens
  misc_feature: HIJSMM301BMKTS.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactagtggctgcaccat

SEQ ID NO: 571178 - DNA, 515 bp, Homo sapiens
  misc_feature: HIJSMM301D2YTU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggaggggaccaagctggccgtcctaggtcagcccaaggctgccccctggtcactctgttccccgccctcctcgagtagtaca

SEQ ID NO: 571179 - DNA, 486 bp, Homo sapiens; identical to SEQ ID NO: 535043
  misc_feature: HIJSMM301A2XEO.46.35.D02.1.454.light.4.raw

SEQ ID NO: 571180 - DNA, 509 bp, Homo sapiens; identical to SEQ ID NO: 559299
  misc_feature: HIJSMM301ESWK1.17.28.C06.1.454.light.4.raw

SEQ ID NO: 571181 - DNA, 515 bp, Homo sapiens
  misc_feature: HIJSMM301ATETR.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttccccg

SEQ ID NO: 571182 - DNA, 500 bp, Homo sapiens
  misc_feature: HIJSMM301B6V2M.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcacgtcctaggtcagcccaaggccaacccactgtca

SEQ ID NO: 571183 - DNA, 486 bp, Homo sapiens
  misc_feature: HIJSMM301EVTPO.52.58.F03.1.454.light.4.raw
cgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagacgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacagacttcactctcaccatcagcggtcttcaacctgaggactttggaacttactactgtcagcagagtgataatacccctcagactttcggccctgggactacagtggatgtcaaacgaactgtgctgcacatctgt

SEQ ID NO: 571184 - DNA, 504 bp, Homo sapiens; identical to SEQ ID NO: 538940
  misc_feature: HIJSMM301DG4OF.2.35.D02.1.454.light.4.raw

SEQ ID NO: 571185 - DNA, 506 bp, Homo sapiens; identical to SEQ ID NO: 548581
  misc_feature: HIJSMM301EUQBC.11.75.G09.1.454.light.4.raw

SEQ ID NO: 571186 - DNA, 513 bp, Homo sapiens; identical to SEQ ID NO: 565259
  misc_feature: HIJSMM301EKKPZ.17.33.C11.1.454.light.4.raw

SEQ ID NO: 571187 - DNA, 501 bp, Homo sapiens
  misc_feature: HIJSMM301BQ4AO.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctcg

SEQ ID NO: 571188 - DNA, 515 bp, Homo sapiens
  misc_feature: HIJSMM301BV9OO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtcaaacgaactagtggcgtgcaccactctgtcttctatcttcccgccact

SEQ ID NO: 571189 - DNA, 504 bp, Homo sapiens; identical to SEQ ID NO: 535561
  misc_feature: HIJSMM301EMG1Z.4.57.F02.1.454.light.4.raw

SEQ ID NO: 571190 - DNA, 489 bp, Homo sapiens
  misc_feature: HIJSMM301A2OXR.48.78.H01.1.454.light.4.raw
agtatacatacacgaccggtgctcgatttagtgtgagtagtttgggtttgggggcagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacgg

SEQ ID NO: 571191 - DNA, 472 bp, Homo sapiens; identical to SEQ ID NO: 536302
  misc_feature: HIJSMM301DPKII.18.76.G10.1.454.light.4.raw

SEQ ID NO: 571192 - DNA, 504 bp, Homo sapiens; identical to SEQ ID NO: 555965
  misc_feature: HIJSMM301BZRCD.48.36.D03.1.454.light.4.raw

SEQ ID NO: 571193 - DNA, 486 bp, Homo sapiens; identical to SEQ ID NO: 535043
  misc_feature: HIJSMM301EHYMH.46.35.D02.1.454.light.4.raw

SEQ ID NO: 571194 - DNA, 447 bp, Homo sapiens; identical to SEQ ID NO: 535020
  misc_feature: HIJSMM301AO1UD.18.9.A09.1.454.light.4.raw

SEQ ID NO: 571195 - DNA, 486 bp, Homo sapiens; identical to SEQ ID NO: 535290
  misc_feature: HIJSMM301CBTBJ.3.12.B01.1.454.light.4.raw

SEQ ID NO: 571196 - DNA, 521 bp, Homo sapiens; identical to SEQ ID NO: 539470
  misc_feature: HIJSMM301C20GK.27.23.C01.1.454.light.4.raw

SEQ ID NO: 571197 - DNA, 490 bp, Homo sapiens; identical to SEQ ID NO: 560257
  misc_feature: HIJSMM301BE3DA.19.57.F02.1.454.light.4.raw

SEQ ID NO: 571198 - DNA, 505 bp, Homo sapiens
  misc_feature: HIJSMM301BX62M.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctcgccccctcggtcta

SEQ ID NO: 571199 - DNA, 444 bp, Homo sapiens; identical to SEQ ID NO: 535594
  misc_feature: HIJSMM301EGVLF.9.9.A09.1.454.light.4.raw

SEQ ID NO: 571200 - DNA, 507 bp, Homo sapiens
  misc_feature: HIJSMM301DLRNK.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaaggtgggacctcaaacgaactgtggctgcaccatctgtcttcatcttcccgcc

SEQ ID NO: 571201 - DNA, 523 bp, Homo sapiens
  misc_feature: HIJSMM301A6NPR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaaactagtttttctcgggcgttcggtccgaacgggaccgaaggtaggaaaatacaaaacgaacctagtggctcggcaccactctgtcttcacttcttcccccg

SEQ ID NO: 571202 - DNA, 496 bp, Homo sapiens; identical to SEQ ID NO: 535109
  misc_feature: HIJSMM301DXHG5.16.78.H01.1.454.light.4.raw

SEQ ID NO: 571203 - DNA, 506 bp, Homo sapiens
  misc_feature: HIJSMM301AGV7F.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtccaaggacgaacggtggaagtacaaacgaactagtggcgtgcaccaactctgtcttctatcttccccg

SEQ ID NO: 571204 - DNA, 509 bp, Homo sapiens
  misc_feature: HIJSMM301BIS64.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccctcagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtctaggtcagcccaaggctgccccctcggtcactctgttcccacctcctcgctacgt

SEQ ID NO: 571205 - DNA, 480 bp, Homo sapiens
  misc_feature: HIJSMM301EFEIR.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgca

SEQ ID NO: 571206 - DNA, 484 bp, Homo sapiens; identical to SEQ ID NO: 535400
  misc_feature: HIJSMM301CY9N8.46.26.C04.1.454.light.4.raw

SEQ ID NO: 571207 - DNA, 495 bp, Homo sapiens; identical to SEQ ID NO: 538942
  misc_feature: HIJSMM301CRTNE.43.61.F06.1.454.light.4.raw

SEQ ID NO: 571208 - DNA, 522 bp, Homo sapiens; identical to SEQ ID NO: 541090
  misc_feature: HIJSMM301A8EBU.27.23.C01.1.454.light.4.raw

SEQ ID NO: 571209 - DNA, 483 bp, Homo sapiens
  misc_feature: HIJSMM301A95M5.52.33.C11.1.454.light.4.raw
cgcagtacgacacgaccggtgctcgatttagagtgagctcgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcg

SEQ ID NO: 571210 - DNA, 485 bp, Homo sapiens; identical to SEQ ID NO: 544293
  misc_feature: HIJSMM301AMY4G.26.70.G04.1.454.light.4.raw

SEQ ID NO: 571211 - DNA, 487 bp, Homo sapiens
  misc_feature: HIJSMM301CFJLJ.53.34.D01.1.454.light.4.raw
cgcgtatacacacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccgaaactgaccgtcctaggtcagcccaaggctccg

SEQ ID NO: 571212 - DNA, 509 bp, Homo sapiens
  misc_feature: HIJSMM301A26GU.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccaacggtaggaaatacaaacgaactagtggctgcaccactctgtcttcatcttccccg

SEQ ID NO: 571213 - DNA, 484 bp, Homo sapiens
  misc_feature: HIJSMM301C6XVI.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccacctcctcgtctcgtaga

SEQ ID NO: 571214 - DNA, 516 bp, Homo sapiens
  misc_feature: HIJSMM301D5Q6M.48.77.G11.1.454.light.4.raw
agtatacatacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccagaaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccg

SEQ ID NO: 571215 - DNA, 497 bp, Homo sapiens; identical to SEQ ID NO: 535286
  misc_feature: HIJSMM301CEG06.18.59.F04.1.454.light.4.raw

SEQ ID NO: 571216 - DNA, 503 bp, Homo sapiens; identical to SEQ ID NO: 569972
  misc_feature: HIJSMM301CKN40.14.57.F02.1.454.light.4.raw

SEQ ID NO: 571217 - DNA, 474 bp, Homo sapiens; identical to SEQ ID NO: 558221
  misc_feature: HIJSMM301AHN9K.12.49.E05.1.454.light.4.raw

SEQ ID NO: 571218 - DNA, 498 bp, Homo sapiens; identical to SEQ ID NO: 547944
  misc_feature: HIJSMM301BLB5D.41.53.E09.1.454.light.4.raw

SEQ ID NO: 571219 - DNA, 447 bp, Homo sapiens; identical to SEQ ID NO: 535201
  misc_feature: HIJSMM301ECIQA.18.9.A09.1.454.light.4.raw

SEQ ID NO: 571220 - DNA, 494 bp, Homo sapiens
  misc_feature: HIJSMM301AETH2.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggggaccaagctggagatcaaacgaactgtgg

SEQ ID NO: 571221 - DNA, 485 bp, Homo sapiens
  misc_feature: HIJSMM301D89SF.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgt

SEQ ID NO: 571222 - DNA, 495 bp, Homo sapiens
  misc_feature: HIJSMM301ARV35.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactagtggctgcaccat

SEQ ID NO: 571223 - DNA, 501 bp, Homo sapiens; identical to SEQ ID NO: 550139
  misc_feature: HIJSMM301CB00S.15.56.F01.1.454.light.4.raw

SEQ ID NO: 571224 - DNA, 452 bp, Homo sapiens; identical to SEQ ID NO: 561401
  misc_feature: HIJSMM301EHRJB.13.23.C01.1.454.light.4.raw

SEQ ID NO: 571225 - DNA, 496 bp, Homo sapiens
  misc_feature: HIJSMM301BWBRT.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaagtcagcccaagg

SEQ ID NO: 571226 - DNA, 460 bp, Homo sapiens; identical to SEQ ID NO: 536053
  misc_feature: HIJSMM301D7CUP.22.28.C06.1.454.light.4.raw

SEQ ID NO: 571227 - DNA, 454 bp, Homo sapiens; identical to SEQ ID NO: 536347
  misc_feature: HIJSMM301ENE75.19.86.H09.1.454.light.4.raw

SEQ ID NO: 571228 - DNA, 463 bp, Homo sapiens
  misc_feature: HIJSMM301C1VG5.10.9.A09.1.454.light.4.raw
catagtagtgcacgaccggtgctcgatttagcgagacgcgcagggggaggaactgctcagttaggacccagagggaaccatggaagccccagctcagcatctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgacactactatg

SEQ ID NO: 571229 - DNA, 447 bp, Homo sapiens
  misc_feature: HIJSMM301DH0KN.18.9.A09.1.454.light.4.raw
tacgagtatgcacgaccggtgctcgatttagcgagacgcgcagggtcctgggcccagtctgtgctgacgcagccgccctcagtgtctggggccctagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 571230 - DNA, 503 bp, Homo sapiens; identical to SEQ ID NO: 543109
  misc_feature: HIJSMM301BCTUY.19.78.H01.1.454.light.4.raw

SEQ ID NO: 571231 - DNA, 493 bp, Homo sapiens
  misc_feature: HIJSMM301B7JR6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagataaaggaactgtggctgcaccatctgtcttcatcttccccg

SEQ ID NO: 571232 - DNA, 493 bp, Homo sapiens
  misc_feature: HIJSMM301BRT8U.10.35.D02.1.454.light.4.raw
catagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttgtcacgggaccgaacgactggaggatacaacgaactacgtggcgtgcaccaact

SEQ ID NO: 571233 - DNA, 487 bp, Homo sapiens; identical to SEQ ID NO: 538190
  misc_feature: HIJSMM301D2OV5.47.70.G04.1.454.light.4.raw

SEQ ID NO: 571234 - DNA, 491 bp, Homo sapiens
  misc_feature: HIJSMM301EHU2Q.49.55.E11.1.454.light.4.raw
agtcgagagacacgaccggtgctcgatttagcactcgcacgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagtataattactggctcgtttttggccaggggaccaagctggagatcaagcgaactgtggctgcaccatctgtcttc

SEQ ID NO: 571235 - DNA, 447 bp, Homo sapiens; identical to SEQ ID NO: 535201
  misc_feature: HIJSMM301DITBY.18.9.A09.1.454.light.4.raw

SEQ ID NO: 571236 - DNA, 501 bp, Homo sapiens; identical to SEQ ID NO: 535746
  misc_feature: HIJSMM301BVONY.18.11.A11.1.454.light.4.raw

SEQ ID NO: 571237 - DNA, 454 bp, Homo sapiens; identical to SEQ ID NO: 534964
  misc_feature: HIJSMM301EXBWH.19.86.H09.1.454.light.4.raw

SEQ ID NO: 571238 - DNA, 503 bp, Homo sapiens
  misc_feature: HIJSMM301ATY7J.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctccgctacgtaga

SEQ ID NO: 571239 - DNA, 507 bp, Homo sapiens; identical to SEQ ID NO: 535641
  misc_feature: HIJSMM301CGN0P.10.88.H11.1.454.light.4.raw

SEQ ID NO: 571240 - DNA, 502 bp, Homo sapiens; identical to SEQ ID NO: 541971
  misc_feature: HIJSMM301BQQZK.4.39.D06.1.454.light.4.raw

SEQ ID NO: 571241 - DNA, 505 bp, Homo sapiens; identical to SEQ ID NO: 539292
  misc_feature: HIJSMM301C3DC7.19.85.H08.1.454.light.4.raw

SEQ ID NO: 571242 - DNA, 485 bp, Homo sapiens; identical to SEQ ID NO: 545103
  misc_feature: HIJSMM301DQFHL.5.42.D09.1.454.light.4.raw

SEQ ID NO: 571243 - DNA, 487 bp, Homo sapiens; identical to SEQ ID NO: 535704
  misc_feature: HIJSMM301EGV7Q.52.83.H06.1.454.light.4.raw

SEQ ID NO: 571244 - DNA, 480 bp, Homo sapiens
  misc_feature: HIJSMM301DZ4BZ.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtggctgcacc

SEQ ID NO: 571245 - DNA, 480 bp, Homo sapiens
  misc_feature: HIJSMM301AXR01.40.59.F04.1.454.light.4.raw
tctagcgactcacgaccggtgctcgatttagtacacacacttagggagttgggctgggcctcaggaagtcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggaccaagctgaccgtcctaagtcagaccccg

SEQ ID NO: 571246 - DNA, 513 bp, Homo sapiens
  misc_feature: HIJSMM301DMCKB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaagtcaaaacgaaacctagtggctgcaccactctgtcttctactcttccccg

SEQ ID NO: 571247 - DNA, 502 bp, Homo sapiens; identical to SEQ ID NO: 541501
  misc_feature: HIJSMM301BKRA4.17.27.C05.1.454.light.4.raw

SEQ ID NO: 571248 - DNA, 486 bp, Homo sapiens; identical to SEQ ID NO: 540090
  misc_feature: HIJSMM301CQ6SC.17.36.D03.1.454.light.4.raw

SEQ ID NO: 571249 - DNA, 497 bp, Homo sapiens; identical to SEQ ID NO: 535286
  misc_feature: HIJSMM301DNUDO.18.59.F04.1.454.light.4.raw

SEQ ID NO: 571250 - DNA, 434 bp, Homo sapiens; identical to SEQ ID NO: 535153
  misc_feature: HIJSMM301BDHAL.18.5.A05.1.454.light.4.raw

SEQ ID NO: 571251 - DNA, 494 bp, Homo sapiens
  misc_feature: HIJSMM301ANDHM.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccagggaccaagctagaaatcaaacgaactgtggctgcaccatctgtcttcta

SEQ ID NO: 571252 - DNA, 454 bp, Homo sapiens; identical to SEQ ID NO: 534964
  misc_feature: HIJSMM301BZKEH.19.86.H09.1.454.light.4.raw

SEQ ID NO: 571253 - DNA, 518 bp, Homo sapiens
  misc_feature: HIJSMM301EM8HK.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctcgccccctcggtccactctcg

SEQ ID NO: 571254 - DNA, 487 bp, Homo sapiens
  misc_feature: HIJSMM301CNOCW.40.83.H06.1.454.light.4.raw
tctagcgactcacgaccggtgctcgatttagatcacgtgcgtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagccccg

SEQ ID NO: 571255 - DNA, 486 bp, Homo sapiens; identical to SEQ ID NO: 535043
  misc_feature: HIJSMM301EXH8N.46.35.D02.1.454.light.4.raw

SEQ ID NO: 571256 - DNA, 504 bp, Homo sapiens; identical to SEQ ID NO: 540538
  misc_feature: HIJSMM301DKOT4.7.71.G05.1.454.light.4.raw

SEQ ID NO: 571257 - DNA, 515 bp, Homo sapiens
  misc_feature: HIJSMM301DSJLT.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaagtcgaaacgaactagtggcgtgcaccatctgtcttcactcttcccgtccact

SEQ ID NO: 571258 - DNA, 463 bp, Homo sapiens
  misc_feature: HIJSMM301EWKY6.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacattttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 571259 - DNA, 472 bp, Homo sapiens
  misc_feature: HIJSMM301BBTCP.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatacaaacgaactgtgg

SEQ ID NO: 571260 - DNA, 486 bp, Homo sapiens; identical to SEQ ID NO: 535043
  misc_feature: HIJSMM301AMVVF.46.35.D02.1.454.light.4.raw

SEQ ID NO: 571261 - DNA, 496 bp, Homo sapiens; identical to SEQ ID NO: 541772
  misc_feature: HIJSMM301C9174.51.81.H04.1.454.light.4.raw

SEQ ID NO: 571262 - DNA, 485 bp, Homo sapiens; identical to SEQ ID NO: 535985
  misc_feature: HIJSMM301DQL2G.15.1.A01.1.454.light.4.raw

SEQ ID NO: 571263 - DNA, 485 bp, Homo sapiens; identical to SEQ ID NO: 535501
  misc_feature: HIJSMM301EYYAS.3.10.A10.1.454.light.4.raw

SEQ ID NO: 571264 - DNA, 505 bp, Homo sapiens
  misc_feature: HIJSMM301CVV1H.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 571265 - DNA, 444 bp, Homo sapiens; identical to SEQ ID NO: 535027
  misc_feature: HIJSMM301AW7Q7.8.73.G07.1.454.light.4.raw

SEQ ID NO: 571266 - DNA, 506 bp, Homo sapiens
  misc_feature: HIJSMM301B13IL.18.35.D02.1.454.light.4.raw
tacgagtatgcacgaccggtgctcgatttagcacacgatagttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 571267 - DNA, 507 bp, Homo sapiens; identical to SEQ ID NO: 550515
  misc_feature: HIJSMM301CURQG.12.73.G07.1.454.light.4.raw

SEQ ID NO: 571268 - DNA, 494 bp, Homo sapiens; identical to SEQ ID NO: 542264
  misc_feature: HIJSMM301CHVF0.13.6.A06.1.454.light.4.raw

SEQ ID NO: 571269 - DNA, 494 bp, Homo sapiens; identical to SEQ ID NO: 534992
  misc_feature: HIJSMM301CLDK1.9.1.A01.1.454.light.4.raw

SEQ ID NO: 571270 - DNA, 517 bp, Homo sapiens; identical to SEQ ID NO: 538903
  misc_feature: HIJSMM301BMBZ9.41.25.C03.1.454.light.4.raw

SEQ ID NO: 571271 - DNA, 510 bp, Homo sapiens; identical to SEQ ID NO: 569498
  misc_feature: HIJSMM301CTWB4.40.33.C11.1.454.light.4.raw

SEQ ID NO: 571272 - DNA, 500 bp, Homo sapiens
  misc_feature: HIJSMM301AJE3R.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcggtcactctcg

SEQ ID NO: 571273 - DNA, 500 bp, Homo sapiens
  misc_feature: HIJSMM301AL31X.5.20.B09.1.454.light.4.raw
atcagacacgcacgaccggtgctcgatttagtgtagtgtgaagggggagctacaacaggcaggcaggggcagcaagatggtgttgcagacccaggtcttcatttctctgttgctctggatctctggtgcctgcgggggcatcgtgatgacccagtctccagactccctggctgtgtctctgggcgagagggccgccatcaactgcaagtccagccagaatattttatacagttccaataataagaactacttagcttggtaccaacagaaaccaggacagcctcctaagctgctcatttcctgggcgtctacccgggaatccggggtccctgaccgattcactggcagcgggtctgggacagatttcactctcaccatcgacagcctgcaggctgaggatgtggcagtttattactgtcagcaacattatagttcgtggacgttcggccaggggaccgaaggtggaaatacaacgaaactgtggctgcaccatctgtctt

SEQ ID NO: 571274 - DNA, 447 bp, Homo sapiens; identical to SEQ ID NO: 535020
  misc_feature: HIJSMM301DAJR0.18.9.A09.1.454.light.4.raw

SEQ ID NO: 571275 - DNA, 507 bp, Homo sapiens
  misc_feature: HIJSMM301AV8RG.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcccgaagattttgcagtttattactgtcagcagcgtagcaactggcctcggttcacttttggccaggggaccaagctggagatcaaacgaactgtggctgcaccatctgtcttcatcttccccg

SEQ ID NO: 571276 - DNA, 484 bp, Homo sapiens; identical to SEQ ID NO: 553010
  misc_feature: HIJSMM301BX3YT.4.8.A08.1.454.light.4.raw

SEQ ID NO: 571277 - DNA, 484 bp, Homo sapiens
  misc_feature: HIJSMM301ET55C.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaacgaactagtgctgcaccat

SEQ ID NO: 571278 - DNA, 493 bp, Homo sapiens
  misc_feature: HIJSMM301AJ92A.40.39.D06.1.454.light.4.raw
tctagcgactcacgaccggtgctcgatttagtgacatctcgcagttctttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccat

SEQ ID NO: 571279 - DNA, 494 bp, Homo sapiens; identical to SEQ ID NO: 534994
  misc_feature: HIJSMM301APLCN.27.78.H01.1.454.light.4.raw

SEQ ID NO: 571280 - DNA, 487 bp, Homo sapiens
  misc_feature: HIJSMM301D8QCM.41.57.F02.1.454.light.4.raw
tctatactatcacgaccggtgctcgatttagctcgatataggttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaaggctgaccgtcctaggtcacg

SEQ ID NO: 571281 - DNA, 488 bp, Homo sapiens; identical to SEQ ID NO: 542699
  misc_feature: HIJSMM301BER6R.12.51.E07.1.454.light.4.raw

SEQ ID NO: 571282 - DNA, 502 bp, Homo sapiens
  misc_feature: HIJSMM301EGVU6.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 571283 - DNA, 494 bp, Homo sapiens; identical to SEQ ID NO: 534994
  misc_feature: HIJSMM301BN3Q6.27.78.H01.1.454.light.4.raw

SEQ ID NO: 571284 - DNA, 498 bp, Homo sapiens; identical to SEQ ID NO: 544837
  misc_feature: HIJSMM301C1ZVY.11.71.G05.1.454.light.4.raw

SEQ ID NO: 571285 - DNA, 501 bp, Homo sapiens
  misc_feature: HIJSMM301B3M4Z.19.71.G05.1.454.light.4.raw
  modified_base (423)..(423): a, c, t, g, unknown or other
tactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaaagntgtggcagtttattattgtcaacaatattattatacttcgtggacgttcggccaagggaccaaggtggagtatcaacg

SEQ ID NO: 571286 - DNA, 488 bp, Homo sapiens; identical to SEQ ID NO: 551150
  misc_feature: HIJSMM301D0RQF.13.87.H10.1.454.light.4.raw

SEQ ID NO: 571287 - DNA, 444 bp, Homo sapiens; identical to SEQ ID NO: 534993
  misc_feature: HIJSMM301BU3L0.5.9.A09.1.454.light.4.raw

SEQ ID NO: 571288 - DNA, 492 bp, Homo sapiens
  misc_feature: HIJSMM301EFVCK.49.15.B04.1.454.light.4.raw
agtcgagagacacgaccggtgctcgatttagacagtatatatccgcgggcacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaaga

SEQ ID NO: 571289 - DNA, 480 bp, Homo sapiens
  misc_feature: HIJSMM301EXWTG.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagccaaggctgccccctcggtcactctgttcccaccctcctccgtgtcctgat

SEQ ID NO: 571290 - DNA, 473 bp, Homo sapiens; identical to SEQ ID NO: 538875
  misc_feature: HIJSMM301B210E.4.75.G09.1.454.light.4.raw

SEQ ID NO: 571291 - DNA, 472 bp, Homo sapiens
  misc_feature: HIJSMM301DAZLP.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctccgagtgccacttttggcggggggtaccaaggtggacatcaaacgaa

SEQ ID NO: 571292 - DNA, 497 bp, Homo sapiens
  misc_feature: HIJSMM301ANU8B.16.78.H01.1.454.light.4.raw
tgtactactccacgaccggtgctcgatttagtgtgagtagtttgggtttgggggaggaactgctcagttagggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 571293 - DNA, 498 bp, Homo sapiens
  misc_feature: HIJSMM301BEJ9B.16.78.H01.1.454.light.4.raw
tgtactactccacgaccggtgctcgatttagtgtgagtagtttgggtttgggggaggaactgctcagttaggacccagacggaaccatggaaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 571294 - DNA, 498 bp, Homo sapiens
  misc_feature: HIJSMM301CHF47.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaatcagcagagtggaggctgaggacgttgggggtttattactgcatgcaaggtctacaaccccgatcaccttcggccgagggacacgcctggagattaaacgaactagtggctgcaccat

SEQ ID NO: 571295 - DNA, 483 bp, Homo sapiens
  misc_feature: HIJSMM301D5KH4.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaacttttggccagggaccaagctggagatcaacgaactgtggctgcaccat

SEQ ID NO: 571296 - DNA, 491 bp, Homo sapiens; identical to SEQ ID NO: 537488
  misc_feature: HIJSMM301B6MXS.15.3.A03.1.454.light.4.raw

SEQ ID NO: 571297 - DNA, 496 bp, Homo sapiens; identical to SEQ ID NO: 535541
  misc_feature: HIJSMM301BOCV8.3.33.C11.1.454.light.4.raw

SEQ ID NO: 571298 - DNA, 491 bp, Homo sapiens
  misc_feature: HIJSMM301C9KAV.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaatcagtagagtggaggctgaggatgttggcgactattactgcctgcaagctcggcaattcccgatcaccttcggcccccgggacacgactggacattaaacgaactgtgg

SEQ ID NO: 571299 - DNA, 497 bp, Homo sapiens; identical to SEQ ID NO: 549756
  misc_feature: HIJSMM301DVVOH.40.57.F02.1.454.light.4.raw

SEQ ID NO: 571300 - DNA, 503 bp, Homo sapiens
  misc_feature: HIJSMM301AFHMQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcggtccaagggaccgaaggtaggagtaatctagacgaactacgtaggcgt

SEQ ID NO: 571301 - DNA, 488 bp, Homo sapiens; identical to SEQ ID NO: 535081
  misc_feature: HIJSMM301EWCX4.26.23.C01.1.454.light.4.raw

SEQ ID NO: 571302 - DNA, 486 bp, Homo sapiens; identical to SEQ ID NO: 544134
  misc_feature: HIJSMM301BDWN1.17.26.C04.1.454.light.4.raw

SEQ ID NO: 571303 - DNA, 498 bp, Homo sapiens
  misc_feature: HIJSMM301CTE3D.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgcggggggaccaagctgaccgtcctaggtcagcccaaggctg

SEQ ID NO: 571304 - DNA, 495 bp, Homo sapiens; identical to SEQ ID NO: 535596
  misc_feature: HIJSMM301CBDZM.10.79.H02.1.454.light.4.raw

SEQ ID NO: 571305 - DNA, 504 bp, Homo sapiens; identical to SEQ ID NO: 536300
  misc_feature: HIJSMM301APRO2.40.9.A09.1.454.light.4.raw

SEQ ID NO: 571306 - DNA, 489 bp, Homo sapiens
  misc_feature: HIJSMM301CW0LH.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccgaaggtacggaaatagagacgaactagtggcgtgcaccact

SEQ ID NO: 571307 - DNA, 519 bp, Homo sapiens
  misc_feature: HIJSMM301DMG43.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaaactgtggctgcaccatctgtcttcatcttccccg

SEQ ID NO: 571308 - DNA, 512 bp, Homo sapiens
  misc_feature: HIJSMM301D1EI0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaacagttttctcgggcgttcggccgaagggaccaaggtaggaaatacgaaacgaaactacgtggtctgcaccatctgtcttctatcttccccg

SEQ ID NO: 571309 - DNA, 485 bp, Homo sapiens
  misc_feature: HIJSMM301AWE67.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactagtggctgcaccatctgtcttcatcttcccgccatctgactagtctacg

SEQ ID NO: 571310 - DNA, 487 bp, Homo sapiens
  misc_feature: HIJSMM301DSQQ7.52.86.H09.1.454.light.4.raw
cgcagtacgacacgaccggtgctcgatttagtgctatagacttggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 571311 - DNA, 478 bp, Homo sapiens; identical to SEQ ID NO: 549111
  misc_feature: HIJSMM301A9LAO.16.86.H09.1.454.light.4.raw

SEQ ID NO: 571312 - DNA, 495 bp, Homo sapiens; identical to SEQ ID NO: 556656
  misc_feature: HIJSMM301DFN3Y.51.83.H06.1.454.light.4.raw

SEQ ID NO: 571313 - DNA, 490 bp, Homo sapiens
  misc_feature: HIJSMM301DX3EO.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgttgatattcggcggagggacctggctgaccgtcctacgtcagcccaa

SEQ ID NO: 571314 - DNA, 503 bp, Homo sapiens
  misc_feature: HIJSMM301EHJC3.18.26.C04.1.454.light.4.raw
tacgagtatgcacgaccggtgctcgatttagtctagcgactttgggtttgggggggtcgagacccacgtcgggacacagcatggacatgagggtccccgcctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgcc

SEQ ID NO: 571315 - DNA, 494 bp, Homo sapiens; identical to SEQ ID NO: 534994
  misc_feature: HIJSMM301EU83O.27.78.H01.1.454.light.4.raw

SEQ ID NO: 571316 - DNA, 492 bp, Homo sapiens; identical to SEQ ID NO: 534967
  misc_feature: HIJSMM301BU1P2.47.64.F09.1.454.light.4.raw

SEQ ID NO: 571317 - DNA, 504 bp, Homo sapiens; identical to SEQ ID NO: 542411
  misc_feature: HIJSMM301DCD0Z.9.53.E09.1.454.light.4.raw

SEQ ID NO: 571318 - DNA, 476 bp, Homo sapiens; identical to SEQ ID NO: 537368
  misc_feature: HIJSMM301B0WQ4.7.83.H06.1.454.light.4.raw

SEQ ID NO: 571319 - DNA, 518 bp, Homo sapiens; identical to SEQ ID NO: 543797
  misc_feature: HIJSMM301EFXMY.19.80.H03.1.454.light.4.raw

SEQ ID NO: 571320 - DNA, 492 bp, Homo sapiens; identical to SEQ ID NO: 535126
  misc_feature: HIJSMM301C0UIL.18.11.A11.1.454.light.4.raw

SEQ ID NO: 571321 - DNA, 447 bp, Homo sapiens; identical to SEQ ID NO: 535020
  misc_feature: HIJSMM301AVWBW.18.9.A09.1.454.light.4.raw

SEQ ID NO: 571322 - DNA, 479 bp, Homo sapiens
  misc_feature: HIJSMM301DTWC0.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagtctgaagattgtgcaatttattactgtcagcaatataatacctggcctccgctcactttcggcggaggaccaaggttgagatacaaacgaactgt

SEQ ID NO: 571323 - DNA, 500 bp, Homo sapiens
  misc_feature: HIJSMM301D0CAP.51.14.B03.1.454.light.4.raw
cgatcgtatacacgaccggtgctcgatttagtgtgagtagttccgcgggggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactagtggctgcaccatctgtcttcatcttccccg

SEQ ID NO: 571324 - DNA, 434 bp, Homo sapiens; identical to SEQ ID NO: 535153
  misc_feature: HIJSMM301CYIRA.18.5.A05.1.454.light.4.raw

SEQ ID NO: 571325 - DNA, 445 bp, Homo sapiens
  misc_feature: HIJSMM301CHRVH.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgccccctcggtcactctgttcccgccctcctcgacacgcgag

SEQ ID NO: 571326 - DNA, 496 bp, Homo sapiens; identical to SEQ ID NO: 535109
  misc_feature: HIJSMM301ESONU.16.78.H01.1.454.light.4.raw

SEQ ID NO: 571327 - DNA, 487 bp, Homo sapiens; identical to SEQ ID NO: 537573
  misc_feature: HIJSMM301D8HJG.3.10.A10.1.454.light.4.raw

SEQ ID NO: 571328 - DNA, 494 bp, Homo sapiens; identical to SEQ ID NO: 556762
  misc_feature: HIJSMM301D5BVE.43.83.H06.1.454.light.4.raw

SEQ ID NO: 571329 - DNA, 495 bp, Homo sapiens; identical to SEQ ID NO: 538269
  misc_feature: HIJSMM301A9H0B.9.1.A01.1.454.light.4.raw

SEQ ID NO: 571330 - DNA, 517 bp, Homo sapiens
  misc_feature: HIJSMM301AFHFT.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 571331 - DNA, 383 bp, Homo sapiens
  misc_feature: HIJSMM301CK6V5.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatctttccgccatctgaatagtataga

SEQ ID NO: 571332 - DNA, 502 bp, Homo sapiens; identical to SEQ ID NO: 539314
  misc_feature: HIJSMM301CAO9T.21.81.H04.1.454.light.4.raw

SEQ ID NO: 571333 - DNA, 440 bp, Homo sapiens; identical to SEQ ID NO: 547410
  misc_feature: HIJSMM301ES5AU.11.3.A03.1.454.light.4.raw

SEQ ID NO: 571334 - DNA, 512 bp, Homo sapiens
  misc_feature: HIJSMM301BXLJK.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggcccactttccggcccgtcgggaccgaaagtggagtatacaaacgaactagtggctgcaccatctgtt

SEQ ID NO: 571335 - DNA, 487 bp, Homo sapiens
  misc_feature: HIJSMM301AMFFJ.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacactttggccaggggaccaagctggagatacaaacgaa

SEQ ID NO: 571336 - DNA, 466 bp, Homo sapiens; identical to SEQ ID NO: 535366
  misc_feature: HIJSMM301BRPHZ.13.4.A04.1.454.light.4.raw

SEQ ID NO: 571337 - DNA, 488 bp, Homo sapiens
  misc_feature: HIJSMM301DEBM7.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgactttactgtcaggcgtgggacagcgacactgccgtgttcggcgggggaccaagctgaccgtcctcggtcagcccaaggctgcccctcggt

SEQ ID NO: 571338 - DNA, 508 bp, Homo sapiens
  misc_feature: HIJSMM301CMBTR.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggccaggctgaccgtcctaagtcagcccaaggctgccccctc

SEQ ID NO: 571339 - DNA, 493 bp, Homo sapiens
  misc_feature: HIJSMM301DYJ7T.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 571340 - DNA, 507 bp, Homo sapiens; identical to SEQ ID NO: 559118
  misc_feature: HIJSMM301BJ2QD.17.87.H10.1.454.light.4.raw

SEQ ID NO: 571341 - DNA, 495 bp, Homo sapiens
  misc_feature: HIJSMM301DQHQ9.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaagggaccaaggtggaaatacaaccgaactagtggctgcaccatctgtcttcatt

SEQ ID NO: 571342 - DNA, 505 bp, Homo sapiens
  misc_feature: HIJSMM301BVCOH.18.78.H01.1.454.light.4.raw
  modified_base (501)..(501): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcagtaatcggccctcaggggtttctaatcgcttctctggctccaagtctggcaacacggcctccctgaccatctctgggctccaggctgagacgaggctgattatactgcagctcatatacaagcagcagcactcaagtcttcggaactgggaccaaggtcaccgtcctaggtcagcccaaggaccaacccactntcta

SEQ ID NO: 571343 - DNA, 491 bp, Homo sapiens
  misc_feature: HIJSMM301A5G65.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagcccaaggctgcccccc

SEQ ID NO: 571344 - DNA, 485 bp, Homo sapiens
  misc_feature: HIJSMM301AMNPU.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtactcatcaaggttcagtgggagtggatctgggacagaattcactttcaccatcagcagcctgcaacctgaagatattgcaacatattactgtcaacagtatgatagtctggccgccttccggtcggagggaccgaaggtaggagagtcgaacgaactagtggcgtgca

SEQ ID NO: 571345 - DNA, 508 bp, Homo sapiens; identical to SEQ ID NO: 550253
  misc_feature: HIJSMM301CHXUX.9.55.E11.1.454.light.4.raw

SEQ ID NO: 571346 - DNA, 352 bp, Homo sapiens; identical to SEQ ID NO: 542316
  misc_feature: HIJSMM301CYHGV.4.67.G01.1.454.light.4.raw

SEQ ID NO: 571347 - DNA, 482 bp, Homo sapiens; identical to SEQ ID NO: 535216
  misc_feature: HIJSMM301BBHOR.17.26.C04.1.454.light.4.raw

SEQ ID NO: 571348 - DNA, 521 bp, Homo sapiens
  misc_feature: HIJSMM301C73Y6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaagtacgaaacgaaactagtaggctggcaccactctgtcttctactcttcccgccact

SEQ ID NO: 571349 - DNA, 506 bp, Homo sapiens; identical to SEQ ID NO: 543993
  misc_feature: HIJSMM301DQEJR.18.78.H01.1.454.light.4.raw

SEQ ID NO: 571350 - DNA, 480 bp, Homo sapiens; identical to SEQ ID NO: 549459
  misc_feature: HIJSMM301CQM5S.21.25.C03.1.454.light.4.raw

SEQ ID NO: 571351 - DNA, 475 bp, Homo sapiens
  misc_feature: HIJSMM301AFUCT.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactagtgg

SEQ ID NO: 571352 - DNA, 487 bp, Homo sapiens
  misc_feature: HIJSMM301ANH91.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagattttgcagtctattactgtcagcagtatggtcacgtccaagtactttggccgacgggaccaagctggagatacaaacgaactgtggctgcaccat

SEQ ID NO: 571353 - DNA, 472 bp, Homo sapiens; identical to SEQ ID NO: 538929
  misc_feature: HIJSMM301B07XB.12.1.A01.1.454.light.4.raw

SEQ ID NO: 571354 - DNA, 518 bp, Homo sapiens
  misc_feature: HIJSMM301AQY5B.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatacaaccgaactgtggctgcaccatctgtcttcatcttcccg

SEQ ID NO: 571355 - DNA, 458 bp, Homo sapiens
  misc_feature: HIJSMM301ANYXJ.49.84.H07.1.454.light.4.raw
agtcgagagacacgaccggtgctcgatttagcagacgtctgtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcgggcggagggacccaagctgaccgt

SEQ ID NO: 571356 - DNA, 478 bp, Homo sapiens
  misc_feature: HIJSMM301DH8ES.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttattctgccagcaatataatagttattggacgttcggccaggggaccaaggtcgaaatgagacgaactgtggctgcac

SEQ ID NO: 571357 - DNA, 496 bp, Homo sapiens; identical to SEQ ID NO: 543995
  misc_feature: HIJSMM301EX1KO.26.80.H03.1.454.light.4.raw

SEQ ID NO: 571358 - DNA, 485 bp, Homo sapiens
  misc_feature: HIJSMM301ELV2T.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggtcaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtca

SEQ ID NO: 571359 - DNA, 493 bp, Homo sapiens
  misc_feature: HIJSMM301EIXWW.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactggtggctgcaccatctgtcttcatcttcccgccat

SEQ ID NO: 571360 - DNA, 470 bp, Homo sapiens; identical to SEQ ID NO: 535302
  misc_feature: HIJSMM301B6398.13.76.G10.1.454.light.4.raw

SEQ ID NO: 571361 - DNA, 480 bp, Homo sapiens; identical to SEQ ID NO: 535630
  misc_feature: HIJSMM301EDFIN.40.59.F04.1.454.light.4.raw

SEQ ID NO: 571362 - DNA, 485 bp, Homo sapiens; identical to SEQ ID NO: 539299
  misc_feature: HIJSMM301AOC08.3.10.A10.1.454.light.4.raw

SEQ ID NO: 571363 - DNA, 496 bp, Homo sapiens; identical to SEQ ID NO: 548177
  misc_feature: HIJSMM301BTB82.18.59.F04.1.454.light.4.raw

SEQ ID NO: 571364 - DNA, 485 bp, Homo sapiens; identical to SEQ ID NO: 541838
  misc_feature: HIJSMM301B3UMR.22.6.A06.1.454.light.4.raw

SEQ ID NO: 571365 - DNA, 485 bp, Homo sapiens
  misc_feature: HIJSMM301EMRY2.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtacccgtacacttttggccagggaccaaactggacatcaaacgaactgtggctgcaccatctgtt

SEQ ID NO: 571366 - DNA, 494 bp, Homo sapiens
  misc_feature: HIJSMM301A6AOM.51.12.B01.1.454.light.4.raw
cgatcgtatacacgaccggtgctcgatttagtagtgtagattccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 571367 - DNA, 505 bp, Homo sapiens; identical to SEQ ID NO: 535503
  misc_feature: HIJSMM301D03Z5.8.28.C06.1.454.light.4.raw

SEQ ID NO: 571368 - DNA, 518 bp, Homo sapiens; identical to SEQ ID NO: 539372
  misc_feature: HIJSMM301D341B.7.86.H09.1.454.light.4.raw

SEQ ID NO: 571369 - DNA, 487 bp, Homo sapiens; identical to SEQ ID NO: 537573
  misc_feature: HIJSMM301CS1ZM.3.10.A10.1.454.light.4.raw

SEQ ID NO: 571370 - DNA, 489 bp, Homo sapiens; identical to SEQ ID NO: 536919
  misc_feature: HIJSMM301EHQKS.22.86.H09.1.454.light.4.raw

SEQ ID NO: 571371 - DNA, 502 bp, Homo sapiens
  misc_feature: HIJSMM301DXTNI.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtca

SEQ ID NO: 571372 - DNA, 516 bp, Homo sapiens
  misc_feature: HIJSMM301DC4Z9.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccacct

SEQ ID NO: 571373 - DNA, 505 bp, Homo sapiens
  misc_feature: HIJSMM301BQ5KQ.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtccagcccaaggctcgccccctcggtcactctcg

SEQ ID NO: 571374 - DNA, 495 bp, Homo sapiens; identical to SEQ ID NO: 535007
  misc_feature: HIJSMM301BJ4DF.22.5.A05.1.454.light.4.raw

SEQ ID NO: 571375 - DNA, 454 bp, Homo sapiens; identical to SEQ ID NO: 536449
  misc_feature: HIJSMM301BGPTY.18.78.H01.1.454.light.4.raw

SEQ ID NO: 571376 - DNA, 507 bp, Homo sapiens; identical to SEQ ID NO: 540930
  misc_feature: HIJSMM301B9PY5.8.34.D01.1.454.light.4.raw

SEQ ID NO: 571377 - DNA, 499 bp, Homo sapiens
  misc_feature: HIJSMM301EJGYW.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcactctcg

SEQ ID NO: 571378 - DNA, 487 bp, Homo sapiens
  misc_feature: HIJSMM301A82KQ.9.64.F09.1.454.light.4.raw
tgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaagcccctaaactcctaatctatgatgcctccattttggaaagtggggtcccatcaaggttcagcggcagtggatctgggacagaattcactctcaccatcagcagcctgcagcctgatgattttgcaacttattactgccaacgccataactggtatttcggccctgggaccaaagtggatgtcaaacgaactgtggctgcaccatctgtattcatcttccccg

SEQ ID NO: 571379 - DNA, 522 bp, Homo sapiens; identical to SEQ ID NO: 540226
  misc_feature: HIJSMM301ERX8J.27.23.C01.1.454.light.4.raw

SEQ ID NO: 571380 - DNA, 496 bp, Homo sapiens; identical to SEQ ID NO: 535597
  misc_feature: HIJSMM301D8M3O.22.20.B09.1.454.light.4.raw

SEQ ID NO: 571381 - DNA, 490 bp, Homo sapiens; identical to SEQ ID NO: 536909
  misc_feature: HIJSMM301BIB1Y.12.27.C05.1.454.light.4.raw

SEQ ID NO: 571382 - DNA, 473 bp, Homo sapiens
  misc_feature: HIJSMM301AVQ41.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactagtgg

SEQ ID NO: 571383 - DNA, 460 bp, Homo sapiens; identical to SEQ ID NO: 540069
  misc_feature: HIJSMM301AHPSI.11.86.H09.1.454.light.4.raw

SEQ ID NO: 571384 - DNA, 493 bp, Homo sapiens; identical to SEQ ID NO: 548028
  misc_feature: HIJSMM301C6RYN.19.83.H06.1.454.light.4.raw

SEQ ID NO: 571385 - DNA, 361 bp, Homo sapiens; identical to SEQ ID NO: 540413
  misc_feature: HIJSMM301DSG8B.3.57.F02.1.454.light.4.raw

SEQ ID NO: 571386 - DNA, 495 bp, Homo sapiens; identical to SEQ ID NO: 553986
  misc_feature: HIJSMM301B7ATD.3.33.C11.1.454.light.4.raw

SEQ ID NO: 571387 - DNA, 488 bp, Homo sapiens; identical to SEQ ID NO: 536554
  misc_feature: HIJSMM301AJL6V.26.37.D04.1.454.light.4.raw

SEQ ID NO: 571388 - DNA, 503 bp, Homo sapiens
  misc_feature: HIJSMM301ADRBE.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 571389 - DNA, 454 bp, Homo sapiens; identical to SEQ ID NO: 536846
  misc_feature: HIJSMM301EH7FW.18.78.H01.1.454.light.4.raw

SEQ ID NO: 571390 - DNA, 512 bp, Homo sapiens
  misc_feature: HIJSMM301CUV78.16.66.F11.1.454.light.4.raw
tgtactactccacgaccggtgctcgatttagtcacgcgagaagggtgagaagtagtggagcccaggccatagtggggatgctccaggctctgcttcctgagctacccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccacagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagcctggccgtcctaggtcagcccaaggctg

SEQ ID NO: 571391 - DNA, 514 bp, Homo sapiens; identical to SEQ ID NO: 545978
  misc_feature: HIJSMM301ARO95.17.33.C11.1.454.light.4.raw

SEQ ID NO: 571392 - DNA, 494 bp, Homo sapiens; identical to SEQ ID NO: 534992
  misc_feature: HIJSMM301B220W.9.1.A01.1.454.light.4.raw

SEQ ID NO: 571393 - DNA, 479 bp, Homo sapiens
  misc_feature: HIJSMM301BLASG.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcacgtttcggcgggggaccaaggtggagatcaagcgaacgtgtggctgcaccta

SEQ ID NO: 571394 - DNA, 511 bp, Homo sapiens
  misc_feature: HIJSMM301BPULI.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgccccctcggtcactctgttcccacctcctctct

SEQ ID NO: 571395 - DNA, 461 bp, Homo sapiens
  misc_feature: HIJSMM301C55TX.49.9.A09.1.454.light.4.raw
agtcgagagacacgaccggtgctcgatttagcgagacgcgcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttcagtggaagtggatctgggacagattttacttcaccatcagcagcctgcagcctgaagatattgcaacatattactgtcaacagtatgataatctcccactcactttcggcggagggaccaaggtggagatcaaacgaa

SEQ ID NO: 571396 - DNA, 522 bp, Homo sapiens
  misc_feature: HIJSMM301CBIOS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagccctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 571397 - DNA, 497 bp, Homo sapiens
  misc_feature: HIJSMM301AERVY.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcact

SEQ ID NO: 571398 - DNA, 436 bp, Homo sapiens
  misc_feature: HIJSMM301DT1KQ.51.29.C07.1.454.light.4.raw
cgatcgtatacacgaccggtgctcgatttagagtgctacgaagggaaagggactggagaaatagtgatgacgcagtctccagccaccctgtctgtgtctccacggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccatctgtcttcatcttcccgccatctgatcgtagcact

SEQ ID NO: 571399 - DNA, 502 bp, Homo sapiens; identical to SEQ ID NO: 541971
  misc_feature: HIJSMM301A9I3Z.4.39.D06.1.454.light.4.raw

SEQ ID NO: 571400 - DNA, 508 bp, Homo sapiens
  misc_feature: HIJSMM301BUP4J.52.67.G01.1.454.light.4.raw
cgcagtacgacacgaccggtgctcgatttagagtatacatattgggtttggggtgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactgggcctccgacgttcggccaagggaccaggtgaaatcaaacgaactgtggctgcaccatctgtcttcat

SEQ ID NO: 571401 - DNA, 521 bp, Homo sapiens
  misc_feature: HIJSMM301AQN3E.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtctaggtcagcccaaggccaaccccactgtcactctgttcccaccctcctccgtcg

SEQ ID NO: 571402 - DNA, 496 bp, Homo sapiens; identical to SEQ ID NO: 537681
  misc_feature: HIJSMM301EH0VA.40.23.C01.1.454.light.4.raw

SEQ ID NO: 571403 - DNA, 486 bp, Homo sapiens
  misc_feature: HIJSMM301EF0JL.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagaccttatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccagggccaagctggagatcaagcgaacg

SEQ ID NO: 571404 - DNA, 471 bp, Homo sapiens
  misc_feature: HIJSMM301C4OC9.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagacaaaaaccagggacagcccctaaactcctgatcctcgatgcatccactttggagacagggtcccatcaaggttcagtggaagtggctctgggacagattttactttcaccatcagcaggctgcagcctgaagatattgcaacatattactgtcaacagtatgatcgcctcccgctcactttcggcgggggtaccaaggtggagagtcaagcgaactgt

SEQ ID NO: 571405 - DNA, 444 bp, Homo sapiens; identical to SEQ ID NO: 535856
  misc_feature: HIJSMM301DPE40.9.9.A09.1.454.light.4.raw

SEQ ID NO: 571406 - DNA, 503 bp, Homo sapiens; identical to SEQ ID NO: 535044
  misc_feature: HIJSMM301ET9O6.19.78.H01.1.454.light.4.raw

SEQ ID NO: 571407 - DNA, 513 bp, Homo sapiens; identical to SEQ ID NO: 535244
  misc_feature: HIJSMM301ESI76.17.33.C11.1.454.light.4.raw

SEQ ID NO: 571408 - DNA, 502 bp, Homo sapiens
  misc_feature: HIJSMM301CISKM.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggaggatcaaacgaactagtggctgcacca

SEQ ID NO: 571409 - DNA, 417 bp, Homo sapiens
  misc_feature: HIJSMM301AEX24.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggcccaaccccactgtcactctcgttcccgccctcctccatactcgta

SEQ ID NO: 571410 - DNA, 487 bp, Homo sapiens; identical to SEQ ID NO: 536025
  misc_feature: HIJSMM301D14AW.17.34.D01.1.454.light.4.raw

SEQ ID NO: 571411 - DNA, 484 bp, Homo sapiens; identical to SEQ ID NO: 535240
  misc_feature: HIJSMM301DWCA1.47.60.F05.1.454.light.4.raw

SEQ ID NO: 571412 - DNA, 497 bp, Homo sapiens; identical to SEQ ID NO: 544396
  misc_feature: HIJSMM301A5PCP.5.24.C02.1.454.light.4.raw

SEQ ID NO: 571413 - DNA, 479 bp, Homo sapiens
  misc_feature: HIJSMM301A51KV.41.5.A05.1.454.light.4.raw
tctatactatcacgaccggtgctcgatttagatagatagacaggggagacccagtcaggacacagcatggacatgagggtccccgctcagctcctggggctcctgctgctctggttcccaggtttcagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccatctgtctt

SEQ ID NO: 571414 - DNA, 515 bp, Homo sapiens
  misc_feature: HIJSMM301BXUHS.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacaacaaaatacagcctctctgaccattactggtctccagcctgacgacgaggctgactactactgctcagcctgggacaccacgcctcgctgcttggtcttttcggcggagggaccaagctgaccgtccgtgggtcacgcccaaggcctcgccccctcggtcctacc

SEQ ID NO: 571415 - DNA, 489 bp, Homo sapiens
  misc_feature: HIJSMM301CFEGR.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattacttgcatgcagggtacagtgtggccttcgctcgcattcggcggagggaccaaggtggaggatcaacgaa

SEQ ID NO: 571416 - DNA, 499 bp, Homo sapiens
  misc_feature: HIJSMM301CTYGL.43.57.F02.1.454.light.4.raw
tgtgagtagtcacgaccggtgctcgatttagctcgatatagttgggtttgggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcacgctgttcccgccctcctcactactcaca

SEQ ID NO: 571417 - DNA, 490 bp, Homo sapiens
  misc_feature: HIJSMM301EORG7.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagaagtggaggctgaggatgttggggtttattactgcatgcaagctctacaaactccttacacttttggccagggaaccgaagctggagatcaaacgaaa

SEQ ID NO: 571418 - DNA, 502 bp, Homo sapiens
  misc_feature: HIJSMM301ANT9E.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgcccctcggtctac

SEQ ID NO: 571419 - DNA, 486 bp, Homo sapiens; identical to SEQ ID NO: 535385
  misc_feature: HIJSMM301CL2JX.19.71.G05.1.454.light.4.raw

SEQ ID NO: 571420 - DNA, 490 bp, Homo sapiens; identical to SEQ ID NO: 535234
  misc_feature: HIJSMM301C7NQ8.17.21.B10.1.454.light.4.raw

SEQ ID NO: 571421 - DNA, 494 bp, Homo sapiens; identical to SEQ ID NO: 535276
  misc_feature: HIJSMM301EEDQR.16.6.A06.1.454.light.4.raw

SEQ ID NO: 571422 - DNA, 500 bp, Homo sapiens
  misc_feature: HIJSMM301CIHD4.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactc

SEQ ID NO: 571423 - DNA, 454 bp, Homo sapiens; identical to SEQ ID NO: 535005
  misc_feature: HIJSMM301A4AOL.19.86.H09.1.454.light.4.raw

SEQ ID NO: 571424 - DNA, 491 bp, Homo sapiens
  misc_feature: HIJSMM301EXW0F.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaatctccttattggtaccagcagaagtcaggccaggcccctgtattggtcatctatgaggacaacagacgaccttccgggatccctgagagattctctggctccacctcagggacaatggccaccttgactatcagtggcgcccacggtggaggatgaggctgactac

SEQ ID NO: 571425 - DNA, 508 bp, Homo sapiens; identical to SEQ ID NO: 552440
  misc_feature: HIJSMM301D4Z57.5.24.C02.1.454.light.4.raw

SEQ ID NO: 571426 - DNA, 495 bp, Homo sapiens
  misc_feature: HIJSMM301AEB2S.13.9.A09.1.454.light.4.raw
tcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggcctgccccctcggtcactctgttcccg

SEQ ID NO: 571427 - DNA, 518 bp, Homo sapiens
  misc_feature: HIJSMM301AX49Y.43.81.H04.1.454.light.4.raw
tgtgagtagtcacgaccggtgctcgatttagtagtgtagattcgcggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctcgttcccgccctcctcacta

SEQ ID NO: 571428 - DNA, 474 bp, Homo sapiens
  misc_feature: HIJSMM301DJEPU.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcgagggaccaaggtggagatcaaacgaactgtggctgcaccatctgt

SEQ ID NO: 571429 - DNA, 500 bp, Homo sapiens
  misc_feature: HIJSMM301AHQIP.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgactcaccttcggccgagggacacgcctggagattaaacgaactagtggctgcaccat

SEQ ID NO: 571430 - DNA, 497 bp, Homo sapiens; identical to SEQ ID NO: 535886
  misc_feature: HIJSMM301B1AVY.8.10.A10.1.454.light.4.raw

SEQ ID NO: 571431 - DNA, 454 bp, Homo sapiens
  misc_feature: HIJSMM301A4XRJ.19.86.H09.1.454.light.4.raw
tactctcgtgcacgaccggtgctcgatttagtgctatagacttgggtttgggggccgtccctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 571432 - DNA, 474 bp, Homo sapiens; identical to SEQ ID NO: 561309
  misc_feature: HIJSMM301EEGBR.5.12.B01.1.454.light.4.raw

SEQ ID NO: 571433 - DNA, 444 bp, Homo sapiens
  misc_feature: HIJSMM301ESDUS.8.11.A11.1.454.light.4.raw
ctcgcgtgtccacgaccggtgctcgatttagctacgactgcagggtcctgggcccagtccgtgctgacgcagccgccctcagtgtctggggccccgggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccaccctcctcgacacgcgag

SEQ ID NO: 571434 - DNA, 484 bp, Homo sapiens
  misc_feature: HIJSMM301B0JO7.40.1.A01.1.454.light.4.raw
tctagcgactcacgaccggtgctcgatttagacgtctcatcaggggcaggagtcgagtcccaaccaggacacagcatggacatgagggtccctgctcagctcctgggctcctgctgctctggctctcaggtgccagatgtgacatccagctgacccagtctccatcctccctgtctgcatctgttggagacagagtcaccatcacttgccgggcaagtcaggacattaaaagtgatttgggctggtatcagcagaaaccacgggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacgttcggtccaacggaccgaacggtaggaaagtacaaacgaacctagtggctcg

SEQ ID NO: 571435 - DNA, 491 bp, Homo sapiens; identical to SEQ ID NO: 559719
  misc_feature: HIJSMM301A8SS8.21.65.F10.1.454.light.4.raw

SEQ ID NO: 571436 - DNA, 493 bp, Homo sapiens; identical to SEQ ID NO: 548028
  misc_feature: HIJSMM301B3VQM.19.83.H06.1.454.light.4.raw

SEQ ID NO: 571437 - DNA, 486 bp, Homo sapiens
  misc_feature: HIJSMM301E086A.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcgggaccgacgagtggatgtcaaacg

SEQ ID NO: 571438 - DNA, 484 bp, Homo sapiens; identical to SEQ ID NO: 536162
  misc_feature: HIJSMM301DYLKK.13.59.F04.1.454.light.4.raw

SEQ ID NO: 571439 - DNA, 502 bp, Homo sapiens; identical to SEQ ID NO: 537363
  misc_feature: HIJSMM301BXF1A.18.23.C01.1.454.light.4.raw

SEQ ID NO: 571440 - DNA, 486 bp, Homo sapiens; identical to SEQ ID NO: 535043
  misc_feature: HIJSMM301C4VHC.46.35.D02.1.454.light.4.raw

SEQ ID NO: 571441 - DNA, 484 bp, Homo sapiens
  misc_feature: HIJSMM301B8C8Z.17.39.D06.1.454.light.4.raw
  modified_base (471)..(471): a, c, t, g, unknown or other
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagtattttgcggtttattactgtcagcagtataatcagtggcctcgtggacgttcggccaagggaccaaggtggaaatnaaacgaactgtgg

SEQ ID NO: 571442 - DNA, 515 bp, Homo sapiens
  misc_feature: HIJSMM301EBD16.43.81.H04.1.454.light.4.raw
tgtgagtagtcacgaccggtgctcgatttagtagtgtagattcgcgggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcacta

SEQ ID NO: 571443 - DNA, 513 bp, Homo sapiens; identical to SEQ ID NO: 543780
  misc_feature: HIJSMM301BP7A3.17.33.C11.1.454.light.4.raw

SEQ ID NO: 571444 - DNA, 447 bp, Homo sapiens; identical to SEQ ID NO: 535020
  misc_feature: HIJSMM301EZXIO.18.9.A09.1.454.light.4.raw

SEQ ID NO: 571445 - DNA, 492 bp, Homo sapiens
  misc_feature: HIJSMM301B9D7Y.15.28.C06.1.454.light.4.raw
tctacgtagccacgaccggtgctcgatttagagctcacgtattgggtttgggggagtcagacgtcagtcaggacacagcatgggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctcgccgcctctactttgcaaagtggggtcccatcaaggttcaggcggcagtggatctgggacagaattcagtctcaccatcagcagcctgcagcctgacgattttgcaacttactactgccaagtgcataataatcatttcggcggagggtaccaaggtggagagtcaaacgaactgtggctgcaccatctgtcttcatt

SEQ ID NO: 571446 - DNA, 460 bp, Homo sapiens; identical to SEQ ID NO: 536053
  misc_feature: HIJSMM301AUKYD.22.28.C06.1.454.light.4.raw

SEQ ID NO: 571447 - DNA, 487 bp, Homo sapiens
  misc_feature: HIJSMM301B097G.12.31.C09.1.454.light.4.raw
  modified_base (365)..(365): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtgggttcccgtcaaggttcactggccgtggatcagggacagaatttacnctcaccatcagtagtctacagcctgaagatattgctacttattactgtcagcagagttaccgcgctcccatcactttcggccaagggacacgaccgcagattggacgaactgtggctgcacc

SEQ ID NO: 571448 - DNA, 444 bp, Homo sapiens; identical to SEQ ID NO: 535027
  misc_feature: HIJSMM301CKHZN.8.73.G07.1.454.light.4.raw

SEQ ID NO: 571449 - DNA, 518 bp, Homo sapiens
  misc_feature: HIJSMM301CJI24.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgcccctcggtcactctgttccaccct

SEQ ID NO: 571450 - DNA, 531 bp, Homo sapiens
  misc_feature: HIJSMM301C2A9T.11.58.F03.1.454.light.4.raw
cgagagataccacgaccggtgctcgatttagtctgatcgagaagggaaaggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttggtaccgacagaccccaggccagcctccacgcacgctcatttataacacaaagactcgctcttctggggtccctaatcgcttctctggctccatccttgggaacaaagctgccctcaccatcacgggggcccaggcggacgatgaatctatttattattgtgtactttttgtgggtcgtggcatttctgctgtgttcggcggaggcacccaggtgaccgtcctcggtcagcccaaggctgccccatccggtcactctcgttcccgccctccc

SEQ ID NO: 571451 - DNA, 494 bp, Homo sapiens; identical to SEQ ID NO: 545671
  misc_feature: HIJSMM301CZ0CK.9.1.A01.1.454.light.4.raw

SEQ ID NO: 571452 - DNA, 503 bp, Homo sapiens; identical to SEQ ID NO: 538973
  misc_feature: HIJSMM301DP246.5.86.H09.1.454.light.4.raw

SEQ ID NO: 571453 - DNA, 498 bp, Homo sapiens; identical to SEQ ID NO: 547944
  misc_feature: HIJSMM301CCLEG.41.53.E09.1.454.light.4.raw

SEQ ID NO: 571454 - DNA, 492 bp, Homo sapiens
  misc_feature: HIJSMM301ETVO6.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacactttggccgggggaccaagctggaaatcaagcgaactgtggctgcaccatctgtcttcatt

SEQ ID NO: 571455 - DNA, 502 bp, Homo sapiens; identical to SEQ ID NO: 536253
  misc_feature: HIJSMM301AXAI0.21.22.B11.1.454.light.4.raw

SEQ ID NO: 571456 - DNA, 508 bp, Homo sapiens
  misc_feature: HIJSMM301ER4Z5.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctggaccatcagcgcggtcgaagccggagatgaggccgactattactgtcaggtgtgggacagtaatagtgatcccgagcaggttttcggcggtgggaccaagctgacgtcctaagtcagcccaaggctgcccctcggtcactctgtt

SEQ ID NO: 571457 - DNA, 499 bp, Homo sapiens
  misc_feature: HIJSMM301A18BC.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcattctgttcccgccctcttctgtcgagcgt

SEQ ID NO: 571458 - DNA, 486 bp, Homo sapiens; identical to SEQ ID NO: 535043
  misc_feature: HIJSMM301CYPUC.46.35.D02.1.454.light.4.raw

SEQ ID NO: 571459 - DNA, 485 bp, Homo sapiens; identical to SEQ ID NO: 535880
  misc_feature: HIJSMM301B0T2T.7.75.G09.1.454.light.4.raw

SEQ ID NO: 571460 - DNA, 492 bp, Homo sapiens
  misc_feature: HIJSMM301A1OIY.51.80.H03.1.454.light.4.raw
cgatcgtatacacgaccggtgctcgatttagctgtgcgtcgaagggaaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaagg

SEQ ID NO: 571461 - DNA, 499 bp, Homo sapiens; identical to SEQ ID NO: 551769
  misc_feature: HIJSMM301EB8B8.43.34.D01.1.454.light.4.raw

SEQ ID NO: 571462 - DNA, 505 bp, Homo sapiens; identical to SEQ ID NO: 535987
  misc_feature: HIJSMM301BULXJ.18.37.D04.1.454.light.4.raw

SEQ ID NO: 571463 - DNA, 491 bp, Homo sapiens
  misc_feature: HIJSMM301D9UWD.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagctttgtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttatactgtcaacaatattatattattccgaggacgttcggccaagggaccaaggtggaaatcaaacgaactgtggctgcaccatctgtcttcatcttcccgccat

SEQ ID NO: 571464 - DNA, 503 bp, Homo sapiens; identical to SEQ ID NO: 536834
  misc_feature: HIJSMM301ENPBW.2.35.D02.1.454.light.4.raw

SEQ ID NO: 571465 - DNA, 518 bp, Homo sapiens
  misc_feature: HIJSMM301DCIEY.7.86.H09.1.454.light.4.raw
cgtgtctctacacgaccggtgctcgatttagtgctatagacttgggtttggggaggagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtgcaatcaaccgaactgtggctgcacatctgtcttcatcttccccg

SEQ ID NO: 571466 - DNA, 513 bp, Homo sapiens; identical to SEQ ID NO: 535719
  misc_feature: HIJSMM301EJ2C9.17.33.C11.1.454.light.4.raw

SEQ ID NO: 571467 - DNA, 475 bp, Homo sapiens; identical to SEQ ID NO: 554487
  misc_feature: HIJSMM301EMQPO.13.76.G10.1.454.light.4.raw

SEQ ID NO: 571468 - DNA, 474 bp, Homo sapiens; identical to SEQ ID NO: 561309
  misc_feature: HIJSMM301EGEWK.5.12.B01.1.454.light.4.raw

SEQ ID NO: 571469 - DNA, 454 bp, Homo sapiens; identical to SEQ ID NO: 535005
  misc_feature: HIJSMM301C6NIF.19.86.H09.1.454.light.4.raw

SEQ ID NO: 571470 - DNA, 507 bp, Homo sapiens
  misc_feature: HIJSMM301BIIZ9.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtggggatactagtagtgatcatgtcttcggacctgggaccaaggtcaccgtcctaggtcagcccaacggccaacccccactgtcactctgttcccaccct

SEQ ID NO: 571471 - DNA, 479 bp, Homo sapiens; identical to SEQ ID NO: 542895
  misc_feature: HIJSMM301CNUZ5.40.59.F04.1.454.light.4.raw

SEQ ID NO: 571472 - DNA, 509 bp, Homo sapiens
  misc_feature: HIJSMM301BYO5E.13.53.E09.1.454.light.4.raw
  modified_base (466)..(466): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactaattgtcaacagagttaccttctcccccggacgtcgtccacggacaacggtaggaagtacaanacgaactacgtggcgtgcaccactctcgtctctactctcccgt

SEQ ID NO: 571473 - DNA, 516 bp, Homo sapiens; identical to SEQ ID NO: 543914
  misc_feature: HIJSMM301DA0WE.5.27.C05.1.454.light.4.raw

SEQ ID NO: 571474 - DNA, 504 bp, Homo sapiens
  misc_feature: HIJSMM301EG05T.15.59.F04.1.454.light.4.raw
tctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctagagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 571475 - DNA, 468 bp, Homo sapiens
  misc_feature: HIJSMM301DFJOK.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctggactgaagtgcatatgaagagaactgtgg

SEQ ID NO: 571476 - DNA, 488 bp, Homo sapiens; identical to SEQ ID NO: 536861
  misc_feature: HIJSMM301EWI6N.12.88.H11.1.454.light.4.raw

SEQ ID NO: 571477 - DNA, 460 bp, Homo sapiens; identical to SEQ ID NO: 539553
  misc_feature: HIJSMM301EI796.11.86.H09.1.454.light.4.raw

SEQ ID NO: 571478 - DNA, 499 bp, Homo sapiens
  misc_feature: HIJSMM301CGQ2U.52.57.F02.1.454.light.4.raw
cgcagtacgacacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgactgtggctgcaccatctgtcttcatt

SEQ ID NO: 571479 - DNA, 519 bp, Homo sapiens
  misc_feature: HIJSMM301CELIL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctgataccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgacggaaccgaacggtaggaaggtacaaacgaactacgtggcgtgcaccactctcgtcttctatcttcccgccact

SEQ ID NO: 571480 - DNA, 506 bp, Homo sapiens
  misc_feature: HIJSMM301C2Y6W.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaacggtaggaaagtacaaacgaactagtggctgcaccactctgtt

SEQ ID NO: 571481 - DNA, 508 bp, Homo sapiens
  misc_feature: HIJSMM301CFXD6.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtggggatccaagggggatggcatccctgatcgcttctcagtcttgggctcaggcctgaatcggtacctgaccatcaagaacatccaggaagaggatgagagtgactaccactgtggggcagaccatggcaggtgggagcaacttcgggggtgttcggcgggagggaccaagctgaccgtctaggtcaggaccccg

SEQ ID NO: 571482 - DNA, 496 bp, Homo sapiens
  misc_feature: HIJSMM301BEDBH.13.9.A09.1.454.light.4.raw
tcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctcgttcccta

SEQ ID NO: 571483 - DNA, 501 bp, Homo sapiens
  misc_feature: HIJSMM301DDLXT.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctacggtcagcccaaggctgccccctcggtcact

SEQ ID NO: 571484 - DNA, 501 bp, Homo sapiens
  misc_feature: HIJSMM301D9HQE.9.12.B01.1.454.light.4.raw
tgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtcaaacgaactgtggctgcaccatctgtcttcta

SEQ ID NO: 571485 - DNA, 494 bp, Homo sapiens
  misc_feature: HIJSMM301BLO1D.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgctagtttttactgtcagcagtatagtaactggcctccgtacacttttggccaggggaccaagctagaatcaaacgaactgtggctgcaccatctgtcttcta

SEQ ID NO: 571486 - DNA, 484 bp, Homo sapiens; identical to SEQ ID NO: 535400
  misc_feature: HIJSMM301A6NE3.46.26.C04.1.454.light.4.raw

SEQ ID NO: 571487 - DNA, 490 bp, Homo sapiens
  misc_feature: HIJSMM301C4BYW.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtcctggtcagccaaggctgccccctc

SEQ ID NO: 571488 - DNA, 497 bp, Homo sapiens
  misc_feature: HIJSMM301B1KUR.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatacaaacgaactgt

SEQ ID NO: 571489 - DNA, 488 bp, Homo sapiens; identical to SEQ ID NO: 535081
  misc_feature: HIJSMM301EHREJ.26.23.C01.1.454.light.4.raw

SEQ ID NO: 571490 - DNA, 504 bp, Homo sapiens
  misc_feature: HIJSMM301BP3W5.16.49.E05.1.454.light.4.raw
tgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggttcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggtcggagggaccaaggtgaccgtcctaggtcagcccaaggctgccccccg

SEQ ID NO: 571491 - DNA, 507 bp, Homo sapiens
  misc_feature: HIJSMM301EB9KY.43.3.A03.1.454.light.4.raw
tgtgagtagtcacgaccggtgctcgatttagagagcgtcacaggggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctggtcactctgttcccg

SEQ ID NO: 571492 - DNA, 479 bp, Homo sapiens; identical to SEQ ID NO: 553368
  misc_feature: HIJSMM301CNKTO.7.76.G10.1.454.light.4.raw

SEQ ID NO: 571493 - DNA, 483 bp, Homo sapiens
  misc_feature: HIJSMM301AZVTO.10.53.E09.1.454.light.4.raw
catagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaaccaaagtggagatacaaacgaa

SEQ ID NO: 571494 - DNA, 454 bp, Homo sapiens; identical to SEQ ID NO: 534964
  misc_feature: HIJSMM301CC9GE.19.86.H09.1.454.light.4.raw

SEQ ID NO: 571495 - DNA, 447 bp, Homo sapiens
  misc_feature: HIJSMM301EDM46.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggaactgggaccaaggtcaccgtcctaggtcagcccaaggccaaccccactgtcactctgttcccgccctcctccatactcgta

SEQ ID NO: 571496 - DNA, 484 bp, Homo sapiens
  misc_feature: HIJSMM301BOELH.41.34.D01.1.454.light.4.raw
tctatactatcacgaccggtgctcgatttagatcgtctgtgttgggtttggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 571497 - DNA, 506 bp, Homo sapiens
  misc_feature: HIJSMM301C0M50.8.33.C11.1.454.light.4.raw
  modified_base (205)..(205): a, c, t, g, unknown or other
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggcctcgggaccaaggtggagatacaacgaactgtggctgcaccatctgtcttcta

SEQ ID NO: 571498 - DNA, 492 bp, Homo sapiens; identical to SEQ ID NO: 534967
  misc_feature: HIJSMM301BOEN8.47.64.F09.1.454.light.4.raw

SEQ ID NO: 571499 - DNA, 487 bp, Homo sapiens; identical to SEQ ID NO: 536206
  misc_feature: HIJSMM301B6DWG.47.38.D05.1.454.light.4.raw

SEQ ID NO: 571500 - DNA, 488 bp, Homo sapiens; identical to SEQ ID NO: 535990
  misc_feature: HIJSMM301CMAM2.11.28.C06.1.454.light.4.raw

SEQ ID NO: 571501 - DNA, 493 bp, Homo sapiens
  misc_feature: HIJSMM301CGO8Y.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtcccgtcaaggttcagtggcagtggatctgggacagatttcactctcaccgtcagcagtctgcaacctgaagtattttgctaacttactactgtcaacagagttacacgtacccccctcacgtttcggcggagggaccaaggcggagatcagacgaactgtggctgcaccatctgtctcta

SEQ ID NO: 571502 - DNA, 463 bp, Homo sapiens; identical to SEQ ID NO: 535062
  misc_feature: HIJSMM301EIGWQ.11.73.G07.1.454.light.4.raw

SEQ ID NO: 571503 - DNA, 493 bp, Homo sapiens
  misc_feature: HIJSMM301ENU3V.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccccactgtcactctgttccccgccctcctctacgtgagct

SEQ ID NO: 571504 - DNA, 493 bp, Homo sapiens; identical to SEQ ID NO: 535657
  misc_feature: HIJSMM301DVNSW.27.78.H01.1.454.light.4.raw

SEQ ID NO: 571505 - DNA, 472 bp, Homo sapiens; identical to SEQ ID NO: 536302
  misc_feature: HIJSMM301AQZEM.18.76.G10.1.454.light.4.raw

SEQ ID NO: 571506 - DNA, 487 bp, Homo sapiens
  misc_feature: HIJSMM301CTRWU.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggt

SEQ ID NO: 571507 - DNA, 521 bp, Homo sapiens; identical to SEQ ID NO: 539470
  misc_feature: HIJSMM301A9YUS.27.23.C01.1.454.light.4.raw

SEQ ID NO: 571508 - DNA, 501 bp, Homo sapiens
  misc_feature: HIJSMM301EF5RL.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcgagggaccaagctgaccgtcctaggtcagcccaagctgccccctcggt

SEQ ID NO: 571509 - DNA, 491 bp, Homo sapiens
  misc_feature: HIJSMM301BNUFI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactttcaccatcagcagactggagcctgaagattttgcagtctattactgtcagcagtatggtcacgtcccaagaacttttggccaggggaccaagctggagatcaaacgaactgtggctgcaccatctgtt

SEQ ID NO: 571510 - DNA, 499 bp, Homo sapiens
  misc_feature: HIJSMM301BTIIO.40.71.G05.1.454.light.4.raw
tctagcgactcacgaccggtgctcgatttagtgtcgtcgcaagagagagggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtctaggtcagccc

SEQ ID NO: 571511 - DNA, 511 bp, Homo sapiens
  misc_feature: HIJSMM301DWKWJ.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgatttattactgtgcaacatgggatgacagcctgaatggtccggtattcggcggagggaccaagctgaccgtcctcggtcagcccaaggctgccccctcggt

SEQ ID NO: 571512 - DNA, 480 bp, Homo sapiens
  misc_feature: HIJSMM301DVCG0.40.59.F04.1.454.light.4.raw
tctagcgactcacgaccggtgctcgatttagtacacacacttagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 571513 - DNA, 504 bp, Homo sapiens; identical to SEQ ID NO: 545009
  misc_feature: HIJSMM301CRFH7.10.9.A09.1.454.light.4.raw

SEQ ID NO: 571514 - DNA, 521 bp, Homo sapiens
  misc_feature: HIJSMM301BWUR7.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggtcgtggggacgaggctgatttattattgcttgttcatatcggccggtgatggtggaccggaagggttggtcggcgggacggaccgaaggtcgaccgtcgtaggtacacgacccgaaggctccgcccccgtcggt

SEQ ID NO: 571515 - DNA, 496 bp, Homo sapiens; identical to SEQ ID NO: 537925
  misc_feature: HIJSMM301D7903.22.14.B03.1.454.light.4.raw

SEQ ID NO: 571516 - DNA, 491 bp, Homo sapiens; identical to SEQ ID NO: 535176
  misc_feature: HIJSMM301D6P78.13.39.D06.1.454.light.4.raw

SEQ ID NO: 571517 - DNA, 454 bp, Homo sapiens; identical to SEQ ID NO: 536347
  misc_feature: HIJSMM301DH8LE.19.86.H09.1.454.light.4.raw

SEQ ID NO: 571518 - DNA, 460 bp, Homo sapiens
  misc_feature: HIJSMM301BMPXU.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctgtctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 571519 - DNA, 497 bp, Homo sapiens; identical to SEQ ID NO: 548768
  misc_feature: HIJSMM301B4956.41.18.B07.1.454.light.4.raw

SEQ ID NO: 571520 - DNA, 492 bp, Homo sapiens
  misc_feature: HIJSMM301DJVDD.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggcacgactggagattaaacgaactgtggctgcaccatctgt

SEQ ID NO: 571521 - DNA, 486 bp, Homo sapiens; identical to SEQ ID NO: 537617
  misc_feature: HIJSMM301DM1RD.10.53.E09.1.454.light.4.raw

SEQ ID NO: 571522 - DNA, 513 bp, Homo sapiens; identical to SEQ ID NO: 542989
  misc_feature: HIJSMM301B7AV6.17.62.F07.1.454.light.4.raw

SEQ ID NO: 571523 - DNA, 512 bp, Homo sapiens
  misc_feature: HIJSMM301BLJ5D.51.53.E09.1.454.light.4.raw
cgatcgtatacacgaccggtgctcgatttagagagagtgtgttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggtccaagggaccgaaggtggaaatcaaacgaaactgtggctgcaccatctgtcttcatt

SEQ ID NO: 571524 - DNA, 483 bp, Homo sapiens; identical to SEQ ID NO: 535413
  misc_feature: HIJSMM301A0DJM.26.78.H01.1.454.light.4.raw

SEQ ID NO: 571525 - DNA, 531 bp, Homo sapiens
  misc_feature: HIJSMM301BNZ9X.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgggtgtcgtcttagttcgttccgttaacggtacggtaccggaccggtaccgtaccgtacccgtacggttacgtacg

SEQ ID NO: 571526 - DNA, 504 bp, Homo sapiens
  misc_feature: HIJSMM301CTFNT.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataccttgtctcctggtaccaacagcaaccaggcaaagcccccaaacttttggtttatcagggcaataagcggccctcaggggtttctaatcgcttctctggctccaagtctggcaacacggccgcctgacaatctctgggctccaggctgacgacgaggctgatttttactgctgctcatatgcaggtgatcactacttttatgttcgggactgggaccaaggtcaccgtcctaggtcagcccaaggccaacccactgtcact

SEQ ID NO: 571527 - DNA, 514 bp, Homo sapiens
  misc_feature: HIJSMM301C6A90.21.87.H10.1.454.light.4.raw
tcgtcgctcgcacgaccggtgctcgatttagcagtactgcgttgggtttggggggggtcgacaagaggcagcgctctcgggacggtctccaccatggcctgggcgtctgctgctcctcactctcctcactcagggcgacagggtccgtgggcccgacgtctgccctcgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggt

SEQ ID NO: 571528 - DNA, 510 bp, Homo sapiens; identical to SEQ ID NO: 537801
  misc_feature: HIJSMM301AKERS.5.60.F05.1.454.light.4.raw

SEQ ID NO: 571529 - DNA, 508 bp, Homo sapiens
  misc_feature: HIJSMM301BWLW3.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagatttcttcttacccctcggacgttcggtccgtacggggaccgacggtgggacgtggtcgtaacgcgaactagtggcgtcgcgaccactccttcg

SEQ ID NO: 571530 - DNA, 493 bp, Homo sapiens
  misc_feature: HIJSMM301C5K8D.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgtatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtcttcta

SEQ ID NO: 571531 - DNA, 441 bp, Homo sapiens; identical to SEQ ID NO: 550529
  misc_feature: HIJSMM301CUBSE.41.9.A09.1.454.light.4.raw

SEQ ID NO: 571532 - DNA, 484 bp, Homo sapiens; identical to SEQ ID NO: 570190
  misc_feature: HIJSMM301ASME2.26.60.F05.1.454.light.4.raw

SEQ ID NO: 571533 - DNA, 486 bp, Homo sapiens; identical to SEQ ID NO: 535043
  misc_feature: HIJSMM301AUBMF.46.35.D02.1.454.light.4.raw

SEQ ID NO: 571534 - DNA, 464 bp, Homo sapiens
  misc_feature: HIJSMM301EBY43.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtaatgatagtctcccgctcactttcggcggggggaccgaaggtggagatcaagcgaa

SEQ ID NO: 571535 - DNA, 511 bp, Homo sapiens; identical to SEQ ID NO: 557789
  misc_feature: HIJSMM301ES9K2.53.71.G05.1.454.light.4.raw

SEQ ID NO: 571536 - DNA, 488 bp, Homo sapiens
  misc_feature: HIJSMM301ES04Y.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcgccaagggaccaaagtaggacatcaagcgaactgtggctgcaccatct

SEQ ID NO: 571537 - DNA, 473 bp, Homo sapiens
  misc_feature: HIJSMM301A2C26.51.33.C11.1.454.light.4.raw
cgatcgtatacacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatctatgaggcatccactttacaatcaggggtcccatctcgtttcagtggcagtggatctgggcacatttcactctcaccatcagcagcctgcagcctgacgatgttgcaacttattactgtcaaaattataacagtgccgttgcgctcactttcggcggggggaccgaacggtggagatcaagcgaa

SEQ ID NO: 571538 - DNA, 497 bp, Homo sapiens; identical to SEQ ID NO: 536371
  misc_feature: HIJSMM301AHO4S.16.78.H01.1.454.light.4.raw

SEQ ID NO: 571539 - DNA, 506 bp, Homo sapiens
  misc_feature: HIJSMM301AT1MI.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggtttcggcggtgggaccaagctgaccgtcctaagtcagccaaggctgcccctcggtcactctgtt

SEQ ID NO: 571540 - DNA, 497 bp, Homo sapiens
  misc_feature: HIJSMM301BH67P.48.53.E09.1.454.light.4.raw
agtatacatacacgaccggtgctcgatttagagagagtgtgttgggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 571541 - DNA, 483 bp, Homo sapiens; identical to SEQ ID NO: 538138
  misc_feature: HIJSMM301DLKG6.41.34.D01.1.454.light.4.raw

SEQ ID NO: 571542 - DNA, 444 bp, Homo sapiens
  misc_feature: HIJSMM301CG949.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgttcccgccctcctctacgtgagct

SEQ ID NO: 571543 - DNA, 494 bp, Homo sapiens
  misc_feature: HIJSMM301AWYRD.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaacccc

SEQ ID NO: 571544 - DNA, 521 bp, Homo sapiens; identical to SEQ ID NO: 539470
  misc_feature: HIJSMM301EMWXQ.27.23.C01.1.454.light.4.raw

SEQ ID NO: 571545 - DNA, 499 bp, Homo sapiens
  misc_feature: HIJSMM301CP246.11.67.G01.1.454.light.4.raw
cgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctcg

SEQ ID NO: 571546 - DNA, 489 bp, Homo sapiens
  misc_feature: HIJSMM301CE20L.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggcctaggggaccaagctggagatcaggcgtaacg

SEQ ID NO: 571547 - DNA, 505 bp, Homo sapiens; identical to SEQ ID NO: 535503
  misc_feature: HIJSMM301EUEB0.8.28.C06.1.454.light.4.raw

SEQ ID NO: 571548 - DNA, 496 bp, Homo sapiens; identical to SEQ ID NO: 538149
  misc_feature: HIJSMM301A3OFW.13.67.G01.1.454.light.4.raw

SEQ ID NO: 571549 - DNA, 491 bp, Homo sapiens
  misc_feature: HIJSMM301AFJ6H.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtctacgtcagcccaaggccaaccccactgtcactctgttccccgccctcctctacgtcgtat

SEQ ID NO: 571550 - DNA, 489 bp, Homo sapiens; identical to SEQ ID NO: 549568
  misc_feature: HIJSMM301C6IZE.43.33.C11.1.454.light.4.raw

SEQ ID NO: 571551 - DNA, 485 bp, Homo sapiens; identical to SEQ ID NO: 550642
  misc_feature: HIJSMM301AXRIG.41.39.D06.1.454.light.4.raw

SEQ ID NO: 571552 - DNA, 486 bp, Homo sapiens; identical to SEQ ID NO: 548935
  misc_feature: HIJSMM301CH223.47.38.D05.1.454.light.4.raw

SEQ ID NO: 571553 - DNA, 496 bp, Homo sapiens; identical to SEQ ID NO: 536690
  misc_feature: HIJSMM301ENTCP.40.23.C01.1.454.light.4.raw

SEQ ID NO: 571554 - DNA, 502 bp, Homo sapiens
  misc_feature: HIJSMM301BWFGN.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtcta

SEQ ID NO: 571555 - DNA, 500 bp, Homo sapiens
  misc_feature: HIJSMM301AG8WZ.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatcc

SEQ ID NO: 571556 - DNA, 447 bp, Homo sapiens; identical to SEQ ID NO: 535020
  misc_feature: HIJSMM301ADJ2Z.18.9.A09.1.454.light.4.raw

SEQ ID NO: 571557 - DNA, 506 bp, Homo sapiens
  misc_feature: HIJSMM301D3EDS.15.66.F11.1.454.light.4.raw
  modified_base (502)..(502): a, c, t, g, unknown or other
tctacgtagccacgaccggtgctcgatttagtcacgcgagaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccccactgtcactctgttcccnccct

SEQ ID NO: 571558 - DNA, 513 bp, Homo sapiens
  misc_feature: HIJSMM301CCX86.8.88.H11.1.454.light.4.raw
ctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggcaagggaccaaggtggcaatcaaccgaactgtggctgcaccatctgtcttcatcttcccgcct

SEQ ID NO: 571559 - DNA, 498 bp, Homo sapiens; identical to SEQ ID NO: 546411
  misc_feature: HIJSMM301AP3KD.48.59.F04.1.454.light.4.raw

SEQ ID NO: 571560 - DNA, 487 bp, Homo sapiens; identical to SEQ ID NO: 539157
  misc_feature: HIJSMM301CFEAW.26.37.D04.1.454.light.4.raw

SEQ ID NO: 571561 - DNA, 413 bp, Homo sapiens
  misc_feature: HIJSMM301ERB2M.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccaccctctcgagtagtaca

SEQ ID NO: 571562 - DNA, 504 bp, Homo sapiens
  misc_feature: HIJSMM301CPASB.7.71.G05.1.454.light.4.raw
  modified_base (206)..(206): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtt

SEQ ID NO: 571563 - DNA, 487 bp, Homo sapiens
  misc_feature: HIJSMM301CS5HK.51.3.A03.1.454.light.4.raw
cgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagccaacggctgccccctccc

SEQ ID NO: 571564 - DNA, 503 bp, Homo sapiens
  misc_feature: HIJSMM301BV4XO.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacacgccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 571565 - DNA, 507 bp, Homo sapiens
  misc_feature: HIJSMM301BVW15.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcta

SEQ ID NO: 571566 - DNA, 487 bp, Homo sapiens; identical to SEQ ID NO: 536025
  misc_feature: HIJSMM301AO0AA.17.34.D01.1.454.light.4.raw

SEQ ID NO: 571567 - DNA, 494 bp, Homo sapiens
  misc_feature: HIJSMM301DSRZY.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagagtcaaacgaactgtggctgcaccatctgtcttcta

SEQ ID NO: 571568 - DNA, 494 bp, Homo sapiens; identical to SEQ ID NO: 534992
  misc_feature: HIJSMM301CFLOY.9.1.A01.1.454.light.4.raw

SEQ ID NO: 571569 - DNA, 509 bp, Homo sapiens; identical to SEQ ID NO: 539359
  misc_feature: HIJSMM301EU41N.47.85.H08.1.454.light.4.raw

SEQ ID NO: 571570 - DNA, 500 bp, Homo sapiens; identical to SEQ ID NO: 545976
  misc_feature: HIJSMM301CW2OG.14.23.C01.1.454.light.4.raw

SEQ ID NO: 571571 - DNA, 488 bp, Homo sapiens
  misc_feature: HIJSMM301BXL6P.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaaactgtggctgcaccactctgtt

SEQ ID NO: 571572 - DNA, 499 bp, Homo sapiens
  misc_feature: HIJSMM301ELL70.49.55.E11.1.454.light.4.raw
agtcgagagacacgaccggtgctcgatttagcactcgcacgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgtcttcat

SEQ ID NO: 571573 - DNA, 502 bp, Homo sapiens; identical to SEQ ID NO: 537816
  misc_feature: HIJSMM301D7JWZ.19.78.H01.1.454.light.4.raw

SEQ ID NO: 571574 - DNA, 496 bp, Homo sapiens; identical to SEQ ID NO: 537925
  misc_feature: HIJSMM301DY4CH.22.14.B03.1.454.light.4.raw

SEQ ID NO: 571575 - DNA, 482 bp, Homo sapiens; identical to SEQ ID NO: 570257
  misc_feature: HIJSMM301EQNJU.41.34.D01.1.454.light.4.raw

SEQ ID NO: 571576 - DNA, 478 bp, Homo sapiens
  misc_feature: HIJSMM301EKECB.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggtggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggg

SEQ ID NO: 571577 - DNA, 514 bp, Homo sapiens
  misc_feature: HIJSMM301ANH4B.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaacccactgtcactctgttcccgccctcc

SEQ ID NO: 571578 - DNA, 489 bp, Homo sapiens; identical to SEQ ID NO: 540381
  misc_feature: HIJSMM301DPYTP.51.6.A06.1.454.light.4.raw

SEQ ID NO: 571579 - DNA, 492 bp, Homo sapiens
  misc_feature: HIJSMM301D4CKC.22.14.B03.1.454.light.4.raw
  modified_base (442)..(442): a, c, t, g, unknown or other
  modified_base (446)..(446): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggaggccaccagtcaactgacaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattccncctnagacgttcggaccaagggaccaaggtggaaatcaaacgaactgtgg

SEQ ID NO: 571580 - DNA, 484 bp, Homo sapiens; identical to SEQ ID NO: 535400
  misc_feature: HIJSMM301EJEZM.46.26.C04.1.454.light.4.raw

SEQ ID NO: 571581 - DNA, 483 bp, Homo sapiens
  misc_feature: HIJSMM301BF6O9.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaactgtgg

SEQ ID NO: 571582 - DNA, 499 bp, Homo sapiens; identical to SEQ ID NO: 563297
  misc_feature: HIJSMM301CUH0R.17.29.C07.1.454.light.4.raw

SEQ ID NO: 571583 - DNA, 490 bp, Homo sapiens
  misc_feature: HIJSMM301BDUER.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactagtggctgcaccatctcgtt

SEQ ID NO: 571584 - DNA, 495 bp, Homo sapiens; identical to SEQ ID NO: 538269
  misc_feature: HIJSMM301CMHTQ.9.1.A01.1.454.light.4.raw

SEQ ID NO: 571585 - DNA, 502 bp, Homo sapiens; identical to SEQ ID NO: 536253
  misc_feature: HIJSMM301CMVHT.21.22.B11.1.454.light.4.raw

SEQ ID NO: 571586 - DNA, 504 bp, Homo sapiens
  misc_feature: HIJSMM301C2WEX.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaacggaccgaacggtaggaaggtacgaaacgaactagtaggtcgtgcgaccactctcgtctt

SEQ ID NO: 571587 - DNA, 447 bp, Homo sapiens; identical to SEQ ID NO: 535020
  misc_feature: HIJSMM301DTCOG.18.9.A09.1.454.light.4.raw

SEQ ID NO: 571588 - DNA, 472 bp, Homo sapiens; identical to SEQ ID NO: 536302
  misc_feature: HIJSMM301ED0ZJ.18.76.G10.1.454.light.4.raw

SEQ ID NO: 571589 - DNA, 508 bp, Homo sapiens
  misc_feature: HIJSMM301AN0SK.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtcccgaacctgaagattttgcaacttactactgtcaacagacttacaatataccgaggaacgttcggtcaagggaccaaaggtggagatcaaacgaactagtggctgcaccatctgtcttcatcttcccgccat

SEQ ID NO: 571590 - DNA, 496 bp, Homo sapiens; identical to SEQ ID NO: 559735
  misc_feature: HIJSMM301BHEB9.13.38.D05.1.454.light.4.raw

SEQ ID NO: 571591 - DNA, 486 bp, Homo sapiens; identical to SEQ ID NO: 535043
  misc_feature: HIJSMM301EQDBC.46.35.D02.1.454.light.4.raw

SEQ ID NO: 571592 - DNA, 508 bp, Homo sapiens
  misc_feature: HIJSMM301BRO22.51.28.C06.1.454.light.4.raw
cgatcgtatacacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcact

SEQ ID NO: 571593 - DNA, 504 bp, Homo sapiens
  misc_feature: HIJSMM301AZNL0.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacgacgactggagattaaaggaacgtagtggtcgtgcgaccactctcgtcttctactctttccccg

SEQ ID NO: 571594 - DNA, 498 bp, Homo sapiens
  misc_feature: HIJSMM301BLCLS.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 571595 - DNA, 483 bp, Homo sapiens; identical to SEQ ID NO: 536697
  misc_feature: HIJSMM301BX6SG.46.26.C04.1.454.light.4.raw

SEQ ID NO: 571596 - DNA, 506 bp, Homo sapiens
  misc_feature: HIJSMM301DDP2G.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagccaaggctgccccctggtcactctgttccca

SEQ ID NO: 571597 - DNA, 527 bp, Homo sapiens
  misc_feature: HIJSMM301ESHI4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaacggaccgaacggtaggaagtacaacgaactagtaggcgtgcaccaactctcgtcttctactcttcccgtccctactctcgtat

SEQ ID NO: 571598 - DNA, 499 bp, Homo sapiens
  misc_feature: HIJSMM301A9HTM.52.34.D01.1.454.light.4.raw
cgcagtacgacacgaccggtgctcgatttagatcgtctgtgttgggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 571599 - DNA, 479 bp, Homo sapiens; identical to SEQ ID NO: 542895
  misc_feature: HIJSMM301C1G2Q.40.59.F04.1.454.light.4.raw

SEQ ID NO: 571600 - DNA, 506 bp, Homo sapiens
  misc_feature: HIJSMM301CAFUK.19.78.H01.1.454.light.4.raw
tactctcgtgcacgaccggtgctcgatttagtgtgagtagtttgggtttggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtca

SEQ ID NO: 571601 - DNA, 492 bp, Homo sapiens
  misc_feature: HIJSMM301DHXJR.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctctgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcta

SEQ ID NO: 571602 - DNA, 477 bp, Homo sapiens
  misc_feature: HIJSMM301ARSYX.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatacaaacgaactgtggctgca

SEQ ID NO: 571603 - DNA, 494 bp, Homo sapiens; identical to SEQ ID NO: 534992
  misc_feature: HIJSMM301CGIMI.9.1.A01.1.454.light.4.raw

SEQ ID NO: 571604 - DNA, 484 bp, Homo sapiens; identical to SEQ ID NO: 536393
  misc_feature: HIJSMM301DM8BS.4.41.D08.1.454.light.4.raw

SEQ ID NO: 571605 - DNA, 508 bp, Homo sapiens
  misc_feature: HIJSMM301AMCQ3.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggacaaggtggagtcagcgaactgtggctgcaccatctgtcttctatcttcccgcccatc

SEQ ID NO: 571606 - DNA, 494 bp, Homo sapiens; identical to SEQ ID NO: 535276
  misc_feature: HIJSMM301DRPGV.16.6.A06.1.454.light.4.raw

SEQ ID NO: 571607 - DNA, 472 bp, Homo sapiens
  misc_feature: HIJSMM301A3XA3.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgattttgctcctccgagtgccacttttggcggggggtaccaaggtggacatcaaacgaa

SEQ ID NO: 571608 - DNA, 476 bp, Homo sapiens; identical to SEQ ID NO: 538611
  misc_feature: HIJSMM301AH761.7.81.H04.1.454.light.4.raw

SEQ ID NO: 571609 - DNA, 488 bp, Homo sapiens; identical to SEQ ID NO: 536554
  misc_feature: HIJSMM301DA90E.26.37.D04.1.454.light.4.raw

SEQ ID NO: 571610 - DNA, 508 bp, Homo sapiens
  misc_feature: HIJSMM301DBEF8.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaagatacaaacgaactgtggctgcaccatctgtt

SEQ ID NO: 571611 - DNA, 497 bp, Homo sapiens; identical to SEQ ID NO: 535664
  misc_feature: HIJSMM301AN3Z7.22.14.B03.1.454.light.4.raw

SEQ ID NO: 571612 - DNA, 484 bp, Homo sapiens
  misc_feature: HIJSMM301AQWQV.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagtattttgactaacttactactgtcaacagtagttcacctacccctctctacgtttcgggcggggacgacggtaggagagacaacgaacgtgt

SEQ ID NO: 571613 - DNA, 483 bp, Homo sapiens; identical to SEQ ID NO: 545413
  misc_feature: HIJSMM301DR586.16.81.H04.1.454.light.4.raw

SEQ ID NO: 571614 - DNA, 487 bp, Homo sapiens
  misc_feature: HIJSMM301CSX5R.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataaatctgcaacctgaggattttgcaacttactactgtcaacagagttacaggcccccctatacttttggccaggggaccaagctggagatcacaggaactgtggctgcacc

SEQ ID NO: 571615 - DNA, 505 bp, Homo sapiens
  misc_feature: HIJSMM301DZNBR.41.21.B10.1.454.light.4.raw
tctatactatcacgaccggtgctcgatttagtgtcgtcgcaagagagggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatcctgtcttcatcttcccgccta

SEQ ID NO: 571616 - DNA, 495 bp, Homo sapiens
  misc_feature: HIJSMM301C3PI2.43.55.E11.1.454.light.4.raw
tgtgagtagtcacgaccggtgctcgatttagcactcgcacgttgggtttggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaaggacgaacgtggaaagtcaaacgaaactgtggctgcaccatctgtcttcatt

SEQ ID NO: 571617 - DNA, 494 bp, Homo sapiens; identical to SEQ ID NO: 535680
  misc_feature: HIJSMM301DM78B.16.78.H01.1.454.light.4.raw

SEQ ID NO: 571618 - DNA, 493 bp, Homo sapiens
  misc_feature: HIJSMM301CGLOH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 571619 - DNA, 491 bp, Homo sapiens; identical to SEQ ID NO: 537488
  misc_feature: HIJSMM301D3ZKV.15.3.A03.1.454.light.4.raw

SEQ ID NO: 571620 - DNA, 499 bp, Homo sapiens; identical to SEQ ID NO: 550040
  misc_feature: HIJSMM301D5XTL.21.38.D05.1.454.light.4.raw

SEQ ID NO: 571621 - DNA, 507 bp, Homo sapiens
  misc_feature: HIJSMM301A8E0N.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccgaacgtggaaatacaaacgaactgtggctgcaccatctgtcttcat

SEQ ID NO: 571622 - DNA, 444 bp, Homo sapiens; identical to SEQ ID NO: 535042
  misc_feature: HIJSMM301BFDUZ.10.76.G10.1.454.light.4.raw

SEQ ID NO: 571623 - DNA, 488 bp, Homo sapiens; identical to SEQ ID NO: 535990
  misc_feature: HIJSMM301EA6CW.11.28.C06.1.454.light.4.raw

SEQ ID NO: 571624 - DNA, 491 bp, Homo sapiens
  misc_feature: HIJSMM301CEEON.49.33.C11.1.454.light.4.raw
agtcgagagacacgaccggtgctcgatttagagtgagctcgttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgtt

SEQ ID NO: 571625 - DNA, 505 bp, Homo sapiens; identical to SEQ ID NO: 540309
  misc_feature: HIJSMM301D0OP6.5.68.G02.1.454.light.4.raw

SEQ ID NO: 571626 - DNA, 501 bp, Homo sapiens; identical to SEQ ID NO: 535873
  misc_feature: HIJSMM301ANK4W.17.27.C05.1.454.light.4.raw

SEQ ID NO: 571627 - DNA, 501 bp, Homo sapiens; identical to SEQ ID NO: 535746
  misc_feature: HIJSMM301B75Y8.18.11.A11.1.454.light.4.raw

SEQ ID NO: 571628 - DNA, 520 bp, Homo sapiens
  misc_feature: HIJSMM301C5NYT.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccagggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 571629 - DNA, 526 bp, Homo sapiens
  misc_feature: HIJSMM301AMJFL.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtgggagagagccacacaattgatggaccaagacggttgggtggttcggcgggagggaccaagctgaccgtcgtaggtcagcccaagggctcggccccctcggtcacctctgttccccaccctcctcgctacgtacgacg

SEQ ID NO: 571630 - DNA, 492 bp, Homo sapiens
  misc_feature: HIJSMM301DER6P.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacagggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctctacttcggcggaggaccgaaggtggagatacgaaacgaactgt

SEQ ID NO: 571631 - DNA, 464 bp, Homo sapiens; identical to SEQ ID NO: 536640
  misc_feature: HIJSMM301AVFE2.26.78.H01.1.454.light.4.raw

SEQ ID NO: 571632 - DNA, 485 bp, Homo sapiens; identical to SEQ ID NO: 536723
  misc_feature: HIJSMM301ADUSM.5.40.D07.1.454.light.4.raw

SEQ ID NO: 571633 - DNA, 503 bp, Homo sapiens
  misc_feature: HIJSMM301DM9AP.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggtttcggcggaggaccaagttgaccgccctaggtcagcccaaggctccg

SEQ ID NO: 571634 - DNA, 494 bp, Homo sapiens; identical to SEQ ID NO: 543077
  misc_feature: HIJSMM301C7CO4.15.26.C04.1.454.light.4.raw

SEQ ID NO: 571635 - DNA, 509 bp, Homo sapiens; identical to SEQ ID NO: 537131
  misc_feature: HIJSMM301CJVZM.17.33.C11.1.454.light.4.raw

SEQ ID NO: 571636 - DNA, 501 bp, Homo sapiens
  misc_feature: HIJSMM301ELWTP.40.62.F07.1.454.light.4.raw
tctagcgactcacgaccggtgctcgatttagtagtcgcataaagggaaagggcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccacggtggt

SEQ ID NO: 571637 - DNA, 494 bp, Homo sapiens
  misc_feature: HIJSMM301CFQXE.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttccca

SEQ ID NO: 571638 - DNA, 512 bp, Homo sapiens
  misc_feature: HIJSMM301EJ7IO.49.35.D02.1.454.light.4.raw
agtcgagagacacgaccggtgctcgatttagcacacgatagttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttccccg

SEQ ID NO: 571639 - DNA, 465 bp, Homo sapiens
  misc_feature: HIJSMM301DN8D7.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaataagcgctgccccgctccagtttcggcgagggaccaaggtggagata

SEQ ID NO: 571640 - DNA, 486 bp, Homo sapiens
  misc_feature: HIJSMM301BIDJH.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtgagatcaaacgtaacg

SEQ ID NO: 571641 - DNA, 481 bp, Homo sapiens
  misc_feature: HIJSMM301DPJJM.4.33.C11.1.454.light.4.raw
agcactgtagcacgaccggtgctcgatttagagtgagctcgttgggtttggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaaactgtggctgcacca

SEQ ID NO: 571642 - DNA, 485 bp, Homo sapiens
  misc_feature: HIJSMM301BDQ64.4.69.G03.1.454.light.4.raw
agcactgtagcacgaccggtgctcgatttagtcgctgcgtaaaggagaaagggggcaggagtcagtctcagtcaggacacagcatggacatgagggtccccgctcagctcctggggctcctgctactctggctccgaggtgccagatgtgacatccagatgacccagtctccatcctccctgtctgcgtctgtaggtgacagcgtcaccatcacttgccgggcaagtcagagtattagtatctatttaaattggtatcagcagaaaccagggaaagtccctaagctcctgatctatggtgcattcaacttgcaaagtgggatcccatcacggttcagtggcagtggatctgggacagatttcactctcaccatcagcagtctgcaacctgaagatttgcaacttacttctgtcaccagagtcacacgtacccctcacacttttggccagggaccaacttagagatacaaacgaactagtggctcg

SEQ ID NO: 571643 - DNA, 505 bp, Homo sapiens; identical to SEQ ID NO: 563996
  misc_feature: HIJSMM301CQ7E5.5.86.H09.1.454.light.4.raw

SEQ ID NO: 571644 - DNA, 497 bp, Homo sapiens
  misc_feature: HIJSMM301B8PK8.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 571645 - DNA, 486 bp, Homo sapiens; identical to SEQ ID NO: 535523
  misc_feature: HIJSMM301BXRU1.22.73.G07.1.454.light.4.raw

SEQ ID NO: 571646 - DNA, 443 bp, Homo sapiens; identical to SEQ ID NO: 535475
  misc_feature: HIJSMM301EE7T3.8.73.G07.1.454.light.4.raw

SEQ ID NO: 571647 - DNA, 499 bp, Homo sapiens
  misc_feature: HIJSMM301EC9PL.27.78.H01.1.454.light.4.raw
  modified_base (407)..(407): a, c, t, g, unknown or other
agcgtcgtctcacgaccggtgctcgatttagtgtgagtagtttgggtttggggatgagcaaaactgacaagtcaaggcaggaagatgttgaccatcacaactcattgggtttctgctgctctgggttccagcctccaggggtgaaattgtgctgactcagtctccaggactttcagtctgtgactccaaaggagaaagtcaccatcacctgccgggccagtcagagcgttggtagtagcttacacgtggtaccagcagaagccaggtcagtctccaaagctcctcatcaagtatgcttcccagtccttctcaggggtcccctcgaggttcagtggcagtggatctgggaccacatttcaccctcaccatcaatagcctggaagctgaagatgctgcaacttattacngtcatcagagtactactttacctcaagtgatcaccttcggcctaagggacacgactggagattaaacgaactgtggctgcaccatctgtctt

SEQ ID NO: 571648 - DNA, 483 bp, Homo sapiens; identical to SEQ ID NO: 542318
  misc_feature: HIJSMM301D6YKS.13.59.F04.1.454.light.4.raw

SEQ ID NO: 571649 - DNA, 441 bp, Homo sapiens; identical to SEQ ID NO: 534971
  misc_feature: HIJSMM301CQGN0.11.3.A03.1.454.light.4.raw

SEQ ID NO: 571650 - DNA, 495 bp, Homo sapiens
  misc_feature: HIJSMM301BNGEX.52.53.E09.1.454.light.4.raw
cgcagtacgacacgaccggtgctcgatttagagagagtgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 571651 - DNA, 491 bp, Homo sapiens; identical to SEQ ID NO: 536988
  misc_feature: HIJSMM301BICC9.17.21.B10.1.454.light.4.raw

SEQ ID NO: 571652 - DNA, 509 bp, Homo sapiens; identical to SEQ ID NO: 547302
  misc_feature: HIJSMM301A4VGG.4.57.F02.1.454.light.4.raw

SEQ ID NO: 571653 - DNA, 447 bp, Homo sapiens; identical to SEQ ID NO: 535882
  misc_feature: HIJSMM301AGE20.18.9.A09.1.454.light.4.raw
  modified_base (429)..(429): a, c, t, g, unknown or other

SEQ ID NO: 571654 - DNA, 491 bp, Homo sapiens
  misc_feature: HIJSMM301DHL5F.43.33.C11.1.454.light.4.raw
  modified_base (435)..(435): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaaccccctcaacttctgatataccgttcatcgctgttgcacgttgggtcccacctcggttcagtggcaacggctctgagacagatttttctctcgtcatcactggtctacagtctgacgacggcgcaatgtacttctgtcaacactatgcctctcccccctanaatttcggtcaggggaccaagttgaacatcaatcgaactgtggctgcaccatctgt

SEQ ID NO: 571655 - DNA, 505 bp, Homo sapiens
  misc_feature: HIJSMM301D3SV3.43.57.F02.1.454.light.4.raw
tgtgagtagtcacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctcgccccctcggt

SEQ ID NO: 571656 - DNA, 508 bp, Homo sapiens
  misc_feature: HIJSMM301D3RZR.40.41.D08.1.454.light.4.raw
tctagcgactcacgaccggtgctcgatttagtcacgcgagaaagggaaagggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagcttcatatacaagcagcagcactccccatgtggtattcggcggagggaccaaggctgaccgtcctaggtcagcccaaggctgcccccc

SEQ ID NO: 571657 - DNA, 504 bp, Homo sapiens
  misc_feature: HIJSMM301DATN3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcaggacaacggtaggaagtacaacgaactagtggctgcaccatctgtcttctactcttcccgccact

SEQ ID NO: 571658 - DNA, 485 bp, Homo sapiens
  misc_feature: HIJSMM301EN96U.48.10.A10.1.454.light.4.raw
agtatacatacacgaccggtgctcgatttagcgtcgatctcaggggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcgtccaaggaccaggtggaatacaaacgaaactgtggctgcaccatctgtcttt

SEQ ID NO: 571659 - DNA, 483 bp, Homo sapiens
  misc_feature: HIJSMM301DA655.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtacccgtacacttttggccagggaccaaactggacatcaaacgaactgtgctgcaccatctgt

SEQ ID NO: 571660 - DNA, 499 bp, Homo sapiens
  misc_feature: HIJSMM301EJYX3.52.37.D04.1.454.light.4.raw
cgcagtacgacacgaccggtgctcgatttagtagcatactgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 571661 - DNA, 472 bp, Homo sapiens; identical to SEQ ID NO: 567932
  misc_feature: HIJSMM301AX7XR.48.49.E05.1.454.light.4.raw

SEQ ID NO: 571662 - DNA, 503 bp, Homo sapiens
  misc_feature: HIJSMM301ENN11.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgcccctcggtcactctgtt

SEQ ID NO: 571663 - DNA, 486 bp, Homo sapiens; identical to SEQ ID NO: 564374
  misc_feature: HIJSMM301EBFN5.4.26.C04.1.454.light.4.raw

SEQ ID NO: 571664 - DNA, 494 bp, Homo sapiens; identical to SEQ ID NO: 534994
  misc_feature: HIJSMM301DRGFM.27.78.H01.1.454.light.4.raw

SEQ ID NO: 571665 - DNA, 523 bp, Homo sapiens
  misc_feature: HIJSMM301DJI2C.27.23.C01.1.454.light.4.raw
agcgtcgtctcacgaccggtgctcgatttagtacacgtgattagggattggggggggtctcaggaggcagcgctctcgggacgtctccaccagtggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccaaactcattctttatgatgtcagtaatcggccccagggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccaccctccc

SEQ ID NO: 571666 - DNA, 495 bp, Homo sapiens
  misc_feature: HIJSMM301DDL90.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggagggaccaaggtgagatcaaacgaactgtggctgcaccatctgtctt

SEQ ID NO: 571667 - DNA, 487 bp, Homo sapiens; identical to SEQ ID NO: 535863
  misc_feature: HIJSMM301A3ABF.19.71.G05.1.454.light.4.raw

SEQ ID NO: 571668 - DNA, 496 bp, Homo sapiens; identical to SEQ ID NO: 566097
  misc_feature: HIJSMM301ESA3K.5.12.B01.1.454.light.4.raw

SEQ ID NO: 571669 - DNA, 478 bp, Homo sapiens
  misc_feature: HIJSMM301BIBVZ.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctccactttcggcgagggaccaaggtggagatcaaacgaactgtggactgctacc

SEQ ID NO: 571670 - DNA, 489 bp, Homo sapiens
  misc_feature: HIJSMM301A64PJ.49.51.E07.1.454.light.4.raw
agtcgagagacacgaccggtgctcgatttagcatactctacaacacacaaagggggcaggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggcaactttttaaattggtatcaacacaaaccagggaaagcccctaaactcctgatctatgctgcatccactttgcaaagtggggtcccttcaaggttccgtggcggtggatctgggacagatttcgctctcaccatcagcagtctccagcctgaagtattttgcgacttactactgtcaacagagtttctctgacctcactttcggcggagggaccacggtggacatacaaacgaactgtggctgcaccat

SEQ ID NO: 571671 - DNA, 491 bp, Homo sapiens; identical to SEQ ID NO: 535294
  misc_feature: HIJSMM301AK7NI.16.68.G02.1.454.light.4.raw

SEQ ID NO: 571672 - DNA, 505 bp, Homo sapiens; identical to SEQ ID NO: 538422
  misc_feature: HIJSMM301AS87Q.19.78.H01.1.454.light.4.raw

SEQ ID NO: 571673 - DNA, 503 bp, Homo sapiens; identical to SEQ ID NO: 545754
  misc_feature: HIJSMM301A4FMP.19.78.H01.1.454.light.4.raw

SEQ ID NO: 571674 - DNA, 487 bp, Homo sapiens; identical to SEQ ID NO: 546036
  misc_feature: HIJSMM301CQT7S.8.12.B01.1.454.light.4.raw

SEQ ID NO: 571675 - DNA, 524 bp, Homo sapiens
  misc_feature: HIJSMM301CWZVD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtccactctgttcccgccctt

SEQ ID NO: 571676 - DNA, 498 bp, Homo sapiens
  misc_feature: HIJSMM301COTG3.10.64.F09.1.454.light.4.raw
catagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctgggacagacttcactctcaccatcaccggcctagaccctgaagattttgcagtttattactgtcagcagcgtagcagctggcccctctccctcactttcggcggagggaccaaggtggagatcaaacgaactgtggctgcaccatctgtcttcta

SEQ ID NO: 571677 - DNA, 493 bp, Homo sapiens; identical to SEQ ID NO: 535084
  misc_feature: HIJSMM301EGP2M.47.64.F09.1.454.light.4.raw

SEQ ID NO: 571678 - DNA, 466 bp, Homo sapiens; identical to SEQ ID NO: 546958
  misc_feature: HIJSMM301EDZMY.11.70.G04.1.454.light.4.raw

SEQ ID NO: 571679 - DNA, 501 bp, Homo sapiens
  misc_feature: HIJSMM301EKK0P.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccacccgtctaccgtgcaagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 571680 - DNA, 491 bp, Homo sapiens; identical to SEQ ID NO: 536693
  misc_feature: HIJSMM301B3DI5.19.83.H06.1.454.light.4.raw

SEQ ID NO: 571681 - DNA, 496 bp, Homo sapiens; identical to SEQ ID NO: 559952
  misc_feature: HIJSMM301D5Q2H.16.78.H01.1.454.light.4.raw

SEQ ID NO: 571682 - DNA, 494 bp, Homo sapiens
  misc_feature: HIJSMM301EMCSY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaaggacacgactggagattaaaggaactgtggctgcaccatctgtcttcatcttccccg

SEQ ID NO: 571683 - DNA, 518 bp, Homo sapiens; identical to SEQ ID NO: 539372
  misc_feature: HIJSMM301BI4JW.7.86.H09.1.454.light.4.raw

SEQ ID NO: 571684 - DNA, 507 bp, Homo sapiens
  misc_feature: HIJSMM301EVNHO.18.78.H01.1.454.light.4.raw
tacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtca

SEQ ID NO: 571685 - DNA, 447 bp, Homo sapiens; identical to SEQ ID NO: 535201
  misc_feature: HIJSMM301AM4WH.18.9.A09.1.454.light.4.raw

SEQ ID NO: 571686 - DNA, 506 bp, Homo sapiens
  misc_feature: HIJSMM301CWC2Z.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggaggactaagctgaccgtcctaagtcagcccaaggctgccccctcggtcactctgttcccca

SEQ ID NO: 571687 - DNA, 486 bp, Homo sapiens; identical to SEQ ID NO: 535043
  misc_feature: HIJSMM301ELH90.46.35.D02.1.454.light.4.raw

SEQ ID NO: 571688 - DNA, 491 bp, Homo sapiens
  misc_feature: HIJSMM301BFK58.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcaggtggatctgggacagatttcactctcaccgtcagcagtctgcaacctgaagattttgcaacttactactgtcaacagagttacagtacccccctcactttcggcggagggaccaaggcggagatacagacgaactgtggctgcaccatctgtcttcta

SEQ ID NO: 571689 - DNA, 488 bp, Homo sapiens; identical to SEQ ID NO: 535125
  misc_feature: HIJSMM301C0H7Q.17.25.C03.1.454.light.4.raw

SEQ ID NO: 571690 - DNA, 513 bp, Homo sapiens; identical to SEQ ID NO: 543780
  misc_feature: HIJSMM301BRL7S.17.33.C11.1.454.light.4.raw

SEQ ID NO: 571691 - DNA, 492 bp, Homo sapiens; identical to SEQ ID NO: 535939
  misc_feature: HIJSMM301AJ2QY.13.5.A05.1.454.light.4.raw

SEQ ID NO: 571692 - DNA, 494 bp, Homo sapiens
  misc_feature: HIJSMM301D7F4P.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaagtaggacgatcaagacgaactagtggctgcaccatctgt

SEQ ID NO: 571693 - DNA, 517 bp, Homo sapiens
  misc_feature: HIJSMM301BTXOI.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctcgccccctcggtcactctgttcccgccctcctccactactatg

SEQ ID NO: 571694 - DNA, 492 bp, Homo sapiens
  misc_feature: HIJSMM301DBN1M.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagttattactgtcagcagtatgatacctggcctccgtacacttttggccgggggaccaagctggaaatcaagcgaactgtggctgcaccatctgtcttcatt

SEQ ID NO: 571695 - DNA, 491 bp, Homo sapiens; identical to SEQ ID NO: 535176
  misc_feature: HIJSMM301AJJBB.13.39.D06.1.454.light.4.raw

SEQ ID NO: 571696 - DNA, 486 bp, Homo sapiens; identical to SEQ ID NO: 543543
  misc_feature: HIJSMM301A71WS.49.3.A03.1.454.light.4.raw

SEQ ID NO: 571697 - DNA, 485 bp, Homo sapiens; identical to SEQ ID NO: 535985
  misc_feature: HIJSMM301C2EVS.15.1.A01.1.454.light.4.raw

SEQ ID NO: 571698 - DNA, 484 bp, Homo sapiens; identical to SEQ ID NO: 535400
  misc_feature: HIJSMM301A5CB0.46.26.C04.1.454.light.4.raw

SEQ ID NO: 571699 - DNA, 501 bp, Homo sapiens; identical to SEQ ID NO: 536142
  misc_feature: HIJSMM301EAMW7.15.1.A01.1.454.light.4.raw

SEQ ID NO: 571700 - DNA, 520 bp, Homo sapiens
  misc_feature: HIJSMM301AQFH9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgtcggtccaacgggaccgaaggtaggaaagtacaaaacgaaaccgtagtaggcgtgcgaccaactctgtcttctatctttccccg

SEQ ID NO: 571701 - DNA, 510 bp, Homo sapiens
  misc_feature: HIJSMM301C48NI.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaatagagacgaactagtggctggtcaccaactctgtcttctactcttcccgt

SEQ ID NO: 571702 - DNA, 490 bp, Homo sapiens; identical to SEQ ID NO: 536909
  misc_feature: HIJSMM301AP90T.12.27.C05.1.454.light.4.raw

SEQ ID NO: 571703 - DNA, 515 bp, Homo sapiens
  misc_feature: HIJSMM301AU72L.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaacccccactgtcactctgttcccgccctcctcga

SEQ ID NO: 571704 - DNA, 473 bp, Homo sapiens; identical to SEQ ID NO: 535262
  misc_feature: HIJSMM301BQ2Q3.8.67.G01.1.454.light.4.raw

SEQ ID NO: 571705 - DNA, 521 bp, Homo sapiens; identical to SEQ ID NO: 538715
  misc_feature: HIJSMM301DKIGS.27.23.C01.1.454.light.4.raw

SEQ ID NO: 571706 - DNA, 504 bp, Homo sapiens
  misc_feature: HIJSMM301ESTJO.7.71.G05.1.454.light.4.raw
  modified_base (206)..(206): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggccctggaccaaagtggatatcaaacgaactgtggctgcaccatctgtt

SEQ ID NO: 571707 - DNA, 481 bp, Homo sapiens
  misc_feature: HIJSMM301A0DVJ.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgt

SEQ ID NO: 571708 - DNA, 495 bp, Homo sapiens; identical to SEQ ID NO: 567082
  misc_feature: HIJSMM301CBSJC.16.78.H01.1.454.light.4.raw

SEQ ID NO: 571709 - DNA, 485 bp, Homo sapiens
  misc_feature: HIJSMM301CXOTO.14.53.E09.1.454.light.4.raw
  modified_base (456)..(456): a, c, t, g, unknown or other
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtnttcggcggagggccaagctgaccgtccta

SEQ ID NO: 571710 - DNA, 493 bp, Homo sapiens
  misc_feature: HIJSMM301B0PF3.43.54.E10.1.454.light.4.raw
tgtgagtagtcacgaccggtgctcgatttagatcgtagcagaacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtgtccatctcctgcaggtctagtcacagcgtcctacacagtgatggaagagcctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggagatcaaacgaaactgtggc

SEQ ID NO: 571711 - DNA, 487 bp, Homo sapiens
  misc_feature: HIJSMM301B38AX.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttatactgtcaacaatattatattattccgaggacgttcggccaagggaccaaggtggaaatacaaacgaa

SEQ ID NO: 571712 - DNA, 521 bp, Homo sapiens
  misc_feature: HIJSMM301AOGD9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacgggaccgaacggtacggaaggtacgaaacgaacctagtaggcgtgcaccactcctgtcttcatcttcccgcccact

SEQ ID NO: 571713 - DNA, 515 bp, Homo sapiens
  misc_feature: HIJSMM301AVJ62.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggtttcggcggaggcaccgaagtgaccgtcctcggtcagcccaaggctgccccctcggtcactctcg

SEQ ID NO: 571714 - DNA, 470 bp, Homo sapiens; identical to SEQ ID NO: 535302
  misc_feature: HIJSMM301B2YOO.13.76.G10.1.454.light.4.raw

SEQ ID NO: 571715 - DNA, 506 bp, Homo sapiens
  misc_feature: HIJSMM301DINJR.2.83.H06.1.454.light.4.raw
acgctcgacacacgaccggtgctcgatttagatcacgtgcgtcgcgggcgtggcaaggacggcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcacg

SEQ ID NO: 571716 - DNA, 502 bp, Homo sapiens; identical to SEQ ID NO: 557696
  misc_feature: HIJSMM301DKCAW.22.15.B04.1.454.light.4.raw

SEQ ID NO: 571717 - DNA, 497 bp, Homo sapiens
  misc_feature: HIJSMM301CKCWG.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtcctgggtcagcccaaggccaaccccactcgtcact

SEQ ID NO: 571718 - DNA, 489 bp, Homo sapiens; identical to SEQ ID NO: 535139
  misc_feature: HIJSMM301DR3X3.14.55.E11.1.454.light.4.raw

SEQ ID NO: 571719 - DNA, 504 bp, Homo sapiens; identical to SEQ ID NO: 554247
  misc_feature: HIJSMM301BK00T.19.78.H01.1.454.light.4.raw

SEQ ID NO: 571720 - DNA, 497 bp, Homo sapiens
  misc_feature: HIJSMM301COMDB.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgattttactgcggaacatgggataccagcctgcatggttgtggttttcggcggagggaccaagctgaccgtcctaagtcagcccaaggct

SEQ ID NO: 571721 - DNA, 484 bp, Homo sapiens; identical to SEQ ID NO: 535400
  misc_feature: HIJSMM301DX5JC.46.26.C04.1.454.light.4.raw

SEQ ID NO: 571722 - DNA, 481 bp, Homo sapiens
  misc_feature: HIJSMM301CT1O8.17.50.E06.1.454.light.4.raw
cgtagactagcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcaggccattagcagctatttaaattggtatcagcagaaaccagggaaagcccctaagctcctgatctatgctgcatccagtttgcaaagtggggtcccattaaggttcagtggcagtggatctgggacagatttcactctcaccatcagcagtctgcaacctgaagattttgcaacttactcctgtcaacagagttacagtaccccgttcacttttggccaggggaccaaggctggagatcaaacgaactgtgg

SEQ ID NO: 571723 - DNA, 511 bp, Homo sapiens
  misc_feature: HIJSMM301C7TAC.18.37.D04.1.454.light.4.raw
  modified_base (450)..(450): a, c, t, g, unknown or other
  modified_base (481)..(481): a, c, t, g, unknown or other
  modified_base (501)..(501): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacaacggcgctcncttcgtcggagggaccgaaggtaggagagtnaaacaactaagtggtctgcncactactgtt

SEQ ID NO: 571724 - DNA, 500 bp, Homo sapiens
  misc_feature: HIJSMM301D9F3R.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaatcggccctcagggtttctaatcgcttctctggctccaagtctggcaacacggcctccctgaccatctctgggctccaggctgatgacgaggctgattattactgcaggtcatatacaatcagcaacacttatgtcttcgggactgggacaagatcaccgtcctaggtcagcccaaggccaaccccatgtca

SEQ ID NO: 571725 - DNA, 500 bp, Homo sapiens; identical to SEQ ID NO: 540484
  misc_feature: HIJSMM301BMM3P.48.73.G07.1.454.light.4.raw

SEQ ID NO: 571726 - DNA, 498 bp, Homo sapiens; identical to SEQ ID NO: 536173
  misc_feature: HIJSMM301BAMCJ.12.86.H09.1.454.light.4.raw

SEQ ID NO: 571727 - DNA, 511 bp, Homo sapiens; identical to SEQ ID NO: 537464
  misc_feature: HIJSMM301BMXMB.7.34.D01.1.454.light.4.raw

SEQ ID NO: 571728 - DNA, 502 bp, Homo sapiens; identical to SEQ ID NO: 541971
  misc_feature: HIJSMM301BDYYI.4.39.D06.1.454.light.4.raw

SEQ ID NO: 571729 - DNA, 505 bp, Homo sapiens
  misc_feature: HIJSMM301C55DN.48.34.D01.1.454.light.4.raw
agtatacatacacgaccggtgctcgatttagatcgtctgtgttgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtctaagtcagcccaaggctgccccctcggtcactctgttccccg

SEQ ID NO: 571730 - DNA, 506 bp, Homo sapiens; identical to SEQ ID NO: 537290
  misc_feature: HIJSMM301CAG7Z.13.11.A11.1.454.light.4.raw

SEQ ID NO: 571731 - DNA, 504 bp, Homo sapiens
  misc_feature: HIJSMM301CYIVN.9.31.C09.1.454.light.4.raw
tgatacgtctcacgaccggtgctcgatttagacgtctcatcaaggaaggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctggt

SEQ ID NO: 571732 - DNA, 337 bp, Homo sapiens
  misc_feature: HIJSMM301B8JQ0.8.34.D01.1.454.light.4.raw
ctcgcgtgtccacgaccggtgctcgatttagatcgtctgtgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcatcttcccgccatctgagacacgcgag

SEQ ID NO: 571733 - DNA, 491 bp, Homo sapiens
  misc_feature: HIJSMM301DFJU8.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagaccaaacgaactgtggctgcaccatctgt

SEQ ID NO: 571734 - DNA, 506 bp, Homo sapiens
  misc_feature: HIJSMM301C28R5.8.34.D01.1.454.light.4.raw
ctcgcgtgtccacgaccggtgctcgatttagatcgtctgtgttgggtttgggggaggaactgctcagttaggacccagagggaaccatggaagcctcagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactagtggctgcaccatctgtctt

SEQ ID NO: 571735 - DNA, 481 bp, Homo sapiens; identical to SEQ ID NO: 535993
  misc_feature: HIJSMM301B50NF.21.25.C03.1.454.light.4.raw

SEQ ID NO: 571736 - DNA, 503 bp, Homo sapiens
  misc_feature: HIJSMM301AMN12.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggtttgggtgttcggcggagggaccaaactgaccgtcctaggtcagcccaa

SEQ ID NO: 571737 - DNA, 447 bp, Homo sapiens; identical to SEQ ID NO: 535201
  misc_feature: HIJSMM301BIK1Z.18.9.A09.1.454.light.4.raw

SEQ ID NO: 571738 - DNA, 516 bp, Homo sapiens; identical to SEQ ID NO: 552129
  misc_feature: HIJSMM301CLDYM.27.23.C01.1.454.light.4.raw

SEQ ID NO: 571739 - DNA, 488 bp, Homo sapiens; identical to SEQ ID NO: 535081
  misc_feature: HIJSMM301DT4ML.26.23.C01.1.454.light.4.raw

SEQ ID NO: 571740 - DNA, 483 bp, Homo sapiens; identical to SEQ ID NO: 564488
  misc_feature: HIJSMM301A1R64.51.41.D08.1.454.light.4.raw

SEQ ID NO: 571741 - DNA, 492 bp, Homo sapiens
  misc_feature: HIJSMM301DRKZ5.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggccctgggaccaaagtggatatcaaacgaactgtggctgcaccat

SEQ ID NO: 571742 - DNA, 495 bp, Homo sapiens; identical to SEQ ID NO: 541961
  misc_feature: HIJSMM301DI646.21.27.C05.1.454.light.4.raw
  modified_base (198)..(198): a, c, t, g, unknown or other

SEQ ID NO: 571743 - DNA, 513 bp, Homo sapiens
  misc_feature: HIJSMM301EZK7R.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggccaaccccactgtcactctgttcccg

SEQ ID NO: 571744 - DNA, 514 bp, Homo sapiens
  misc_feature: HIJSMM301B9LJY.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccacctcctcg

SEQ ID NO: 571745 - DNA, 486 bp, Homo sapiens
  misc_feature: HIJSMM301CNS2X.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactagtggctgcaccat

SEQ ID NO: 571746 - DNA, 503 bp, Homo sapiens; identical to SEQ ID NO: 535044
  misc_feature: HIJSMM301BX7S9.19.78.H01.1.454.light.4.raw

SEQ ID NO: 571747 - DNA, 511 bp, Homo sapiens
  misc_feature: HIJSMM301DQ4DD.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataaatttctgggtgttcggcggagggaccaaaactgaccgtcctaggtcagcccaaggctgccccctcggtcactctgttccccg

SEQ ID NO: 571748 - DNA, 462 bp, Homo sapiens
  misc_feature: HIJSMM301EDWF7.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgacactactat

SEQ ID NO: 571749 - DNA, 494 bp, Homo sapiens; identical to SEQ ID NO: 535276
  misc_feature: HIJSMM301AFPLY.16.6.A06.1.454.light.4.raw

SEQ ID NO: 571750 - DNA, 504 bp, Homo sapiens; identical to SEQ ID NO: 535128
  misc_feature: HIJSMM301D6L6P.19.85.H08.1.454.light.4.raw

SEQ ID NO: 571751 - DNA, 483 bp, Homo sapiens; identical to SEQ ID NO: 535413
  misc_feature: HIJSMM301DCWE5.26.78.H01.1.454.light.4.raw

SEQ ID NO: 571752 - DNA, 463 bp, Homo sapiens; identical to SEQ ID NO: 535062
  misc_feature: HIJSMM301A0MPF.11.73.G07.1.454.light.4.raw

SEQ ID NO: 571753 - DNA, 484 bp, Homo sapiens; identical to SEQ ID NO: 538770
  misc_feature: HIJSMM301C888R.4.57.F02.1.454.light.4.raw

SEQ ID NO: 571754 - DNA, 490 bp, Homo sapiens; identical to SEQ ID NO: 538714
  misc_feature: HIJSMM301CO4CF.11.12.B01.1.454.light.4.raw

SEQ ID NO: 571755 - DNA, 506 bp, Homo sapiens; identical to SEQ ID NO: 538849
  misc_feature: HIJSMM301CB8N6.43.15.B04.1.454.light.4.raw

SEQ ID NO: 571756 - DNA, 487 bp, Homo sapiens; identical to SEQ ID NO: 537220
  misc_feature: HIJSMM301C4DOE.16.53.E09.1.454.light.4.raw

SEQ ID NO: 571757 - DNA, 493 bp, Homo sapiens
  misc_feature: HIJSMM301EUHWK.48.71.G05.1.454.light.4.raw
agtatacatacacgaccggtgctcgatttagtgtcgtcgcaagagagaggggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttccgccatctgatatgtatact

SEQ ID NO: 571758 - DNA, 487 bp, Homo sapiens
  misc_feature: HIJSMM301DS6AZ.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggccaggggaccaagctggagatcaaacga

SEQ ID NO: 571759 - DNA, 477 bp, Homo sapiens; identical to SEQ ID NO: 537453
  misc_feature: HIJSMM301A1EB4.8.85.H08.1.454.light.4.raw

SEQ ID NO: 571760 - DNA, 513 bp, Homo sapiens
  misc_feature: HIJSMM301DIAS5.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctccccacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcct

SEQ ID NO: 571761 - DNA, 472 bp, Homo sapiens; identical to SEQ ID NO: 541249
  misc_feature: HIJSMM301CG0GV.5.28.C06.1.454.light.4.raw

SEQ ID NO: 571762 - DNA, 497 bp, Homo sapiens
  misc_feature: HIJSMM301DJ46L.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctcttttcggcgggggaccgaagctggaggatcaaccgaactgtggctgcaccatctgtt

SEQ ID NO: 571763 - DNA, 485 bp, Homo sapiens; identical to SEQ ID NO: 535880
  misc_feature: HIJSMM301A6JYL.7.75.G09.1.454.light.4.raw

SEQ ID NO: 571764 - DNA, 494 bp, Homo sapiens; identical to SEQ ID NO: 534992
  misc_feature: HIJSMM301EZOAJ.9.1.A01.1.454.light.4.raw

SEQ ID NO: 571765 - DNA, 494 bp, Homo sapiens; identical to SEQ ID NO: 534992
  misc_feature: HIJSMM301EE2X9.9.1.A01.1.454.light.4.raw

SEQ ID NO: 571766 - DNA, 494 bp, Homo sapiens; identical to SEQ ID NO: 535276
  misc_feature: HIJSMM301EZBKJ.16.6.A06.1.454.light.4.raw

SEQ ID NO: 571767 - DNA, 485 bp, Homo sapiens
  misc_feature: HIJSMM301D8IDS.3.12.B01.1.454.light.4.raw
agacgcactccacgaccggtgctcgatttagtagtgtagattccgcgggggaggaactgctcagttaggacccagacggaaccatggaagccccagcgcagcttctcttcctctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 571768 - DNA, 490 bp, Homo sapiens
  misc_feature: HIJSMM301DIWQD.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagtcaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtctactttcggcggagggaccaaggtggagatcaaacgaactgtggctgcaccat

SEQ ID NO: 571769 - DNA, 493 bp, Homo sapiens
  misc_feature: HIJSMM301EMJC9.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggggtttattactgcatgcaagctctacaaactccttacacttttggccagggggccaaagctggagatcaaacgaactgt

SEQ ID NO: 571770 - DNA, 503 bp, Homo sapiens
  misc_feature: HIJSMM301EO0J8.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggaggatcagacgaactgtggctgcaccatctgtcttcatcttcccg

SEQ ID NO: 571771 - DNA, 487 bp, Homo sapiens; identical to SEQ ID NO: 540557
  misc_feature: HIJSMM301BLBY9.41.44.D11.1.454.light.4.raw

SEQ ID NO: 571772 - DNA, 480 bp, Homo sapiens; identical to SEQ ID NO: 535291
  misc_feature: HIJSMM301A9486.22.59.F04.1.454.light.4.raw

SEQ ID NO: 571773 - DNA, 503 bp, Homo sapiens; identical to SEQ ID NO: 540029
  misc_feature: HIJSMM301DR4O7.7.71.G05.1.454.light.4.raw

SEQ ID NO: 571774 - DNA, 521 bp, Homo sapiens; identical to SEQ ID NO: 538715
  misc_feature: HIJSMM301C6F88.27.23.C01.1.454.light.4.raw

SEQ ID NO: 571775 - DNA, 492 bp, Homo sapiens; identical to SEQ ID NO: 541945
  misc_feature: HIJSMM301EEPP1.49.67.G01.1.454.light.4.raw

SEQ ID NO: 571776 - DNA, 510 bp, Homo sapiens
  misc_feature: HIJSMM301BQMNM.4.21.B10.1.454.light.4.raw
agcactgtagcacgaccggtgctcgatttagtgtcgtcgcaagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactaactgttactcaatagagaacagtgataatttctgggtgttcggcggagggaccaaactgaccgtcctaggtcagcccaaggctcgccccctcggtcactcttcg

SEQ ID NO: 571777 - DNA, 477 bp, Homo sapiens
  misc_feature: HIJSMM301DLVUD.40.59.F04.1.454.light.4.raw
tctagcgactcacgaccggtgctcgatttagtacacacacttagggattgggggctgggcctcaggaagcagcatcggaggtgcctcagccatggcatggatccctctcttcctcggcgtccttgcttactgcacaggctccgtggcctcctatgacttgactcagccaccctcagtgtcccgtgtccccaggacagacagccaccatcacctgttctggagatagattggcatataaatatgcttcctggtatcagcagaagccaggcccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgtaggtggttttcggcggagggaccaagctgaccgtcctaagtca

SEQ ID NO: 571778 - DNA, 487 bp, Homo sapiens; identical to SEQ ID NO: 539157
  misc_feature: HIJSMM301C7MIB.26.37.D04.1.454.light.4.raw

SEQ ID NO: 571779 - DNA, 377 bp, Homo sapiens; identical to SEQ ID NO: 536071
  misc_feature: HIJSMM301E28NM.40.9.A09.1.454.light.4.raw

SEQ ID NO: 571780 - DNA, 466 bp, Homo sapiens; identical to SEQ ID NO: 535366
  misc_feature: HIJSMM301C975X.13.4.A04.1.454.light.4.raw

SEQ ID NO: 571781 - DNA, 486 bp, Homo sapiens; identical to SEQ ID NO: 535043
  misc_feature: HIJSMM301B3Z5E.46.35.D02.1.454.light.4.raw

SEQ ID NO: 571782 - DNA, 442 bp, Homo sapiens
  misc_feature: HIJSMM301AJXCU.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcttccctggccatcactgggctccagcctgaggatgaggctgattattactgtcagtcctttgacattaaactggatgtggtattcggcggagggacccacgtaaccgtcctaggtcagcccaaggctcgccccctcggtcactctgttcccgccctcctcgtatctctcg

SEQ ID NO: 571783 - DNA, 497 bp, Homo sapiens
  misc_feature: HIJSMM301DZBF6.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcgggcgggggaccgaaggtggagttcaaacgaactgtggctgcaccatctgtcttcatt

SEQ ID NO: 571784 - DNA, 494 bp, Homo sapiens; identical to SEQ ID NO: 535478
  misc_feature: HIJSMM301ECKSZ.10.79.H02.1.454.light.4.raw

SEQ ID NO: 571785 - DNA, 503 bp, Homo sapiens
  misc_feature: HIJSMM301AQQZ5.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattatctactccgccgacgtcggccggggaccacgtggaaatcaaacgaactgtggctgcaccatctgtcttcta

SEQ ID NO: 571786 - DNA, 489 bp, Homo sapiens
  misc_feature: HIJSMM301BWVI0.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 571787 - DNA, 504 bp, Homo sapiens; identical to SEQ ID NO: 535561
  misc_feature: HIJSMM301AE7MK.4.57.F02.1.454.light.4.raw

SEQ ID NO: 571788 - DNA, 500 bp, Homo sapiens
  misc_feature: HIJSMM301EELP4.51.69.G03.1.454.light.4.raw
cgatcgtatacacgaccggtgctcgatttagtcgctgcgtaaaggagaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcggcggagggaccaaggtgaccgtcctaagtcacg

SEQ ID NO: 571789 - DNA, 472 bp, Homo sapiens
  misc_feature: HIJSMM301CKT7D.51.34.D01.1.454.light.4.raw
cgatcgtatacacgaccggtgctcgatttagatcgtctgtgttgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccaaggtggaggatcaagcgaa

SEQ ID NO: 571790 - DNA, 490 bp, Homo sapiens; identical to SEQ ID NO: 535526
  misc_feature: HIJSMM301D007P.26.78.H01.1.454.light.4.raw

SEQ ID NO: 571791 - DNA, 515 bp, Homo sapiens; identical to SEQ ID NO: 538805
  misc_feature: HIJSMM301C2BN0.14.19.B08.1.454.light.4.raw

SEQ ID NO: 571792 - DNA, 487 bp, Homo sapiens
  misc_feature: HIJSMM301DUR5H.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtctattactgtcagcaatataattactggctctctttcggcgggggaccaagctggagatcaaccgaactgtggctgcaccatctgtctt

SEQ ID NO: 571793 - DNA, 491 bp, Homo sapiens; identical to SEQ ID NO: 535294
  misc_feature: HIJSMM301DQSYM.16.68.G02.1.454.light.4.raw

SEQ ID NO: 571794 - DNA, 485 bp, Homo sapiens; identical to SEQ ID NO: 536263
  misc_feature: HIJSMM301CLTC2.47.78.H01.1.454.light.4.raw

SEQ ID NO: 571795 - DNA, 509 bp, Homo sapiens; identical to SEQ ID NO: 540854
  misc_feature: HIJSMM301DDJ1Q.4.71.G05.1.454.light.4.raw

SEQ ID NO: 571796 - DNA, 489 bp, Homo sapiens; identical to SEQ ID NO: 537426
  misc_feature: HIJSMM301BTUSK.16.72.G06.1.454.light.4.raw

SEQ ID NO: 571797 - DNA, 504 bp, Homo sapiens
  misc_feature: HIJSMM301EYJ4D.48.70.G04.1.454.light.4.raw
agtatacatacacgaccggtgctcgatttagtgtagtgtgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaagggaccaacggtggtaaagtacaaacgaaactagtggctgcgacca

SEQ ID NO: 571798 - DNA, 501 bp, Homo sapiens; identical to SEQ ID NO: 536142
  misc_feature: HIJSMM301C114M.15.1.A01.1.454.light.4.raw

SEQ ID NO: 571799 - DNA, 505 bp, Homo sapiens
  misc_feature: HIJSMM301BXPJU.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggagcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 571800 - DNA, 524 bp, Homo sapiens
  misc_feature: HIJSMM301EFOD4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaagtacgaaacgaaactagtaggtcgtgtcgaccactctgtcttctatcttcccgtccact

SEQ ID NO: 571801 - DNA, 462 bp, Homo sapiens
  misc_feature: HIJSMM301DGT1B.41.14.B03.1.454.light.4.raw
tctatactatcacgaccggtgctcgattttagtgtgagtagttccgcgggcacgaccggtgctcgatttagtgtgagttgttccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 571802 - DNA, 487 bp, Homo sapiens
  misc_feature: HIJSMM301B690Y.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggccaagctgaccgtcctaggtcagcccc

SEQ ID NO: 571803 - DNA, 494 bp, Homo sapiens; identical to SEQ ID NO: 535629
  misc_feature: HIJSMM301AV1H3.4.27.C05.1.454.light.4.raw

SEQ ID NO: 571804 - DNA, 444 bp, Homo sapiens
  misc_feature: HIJSMM301BXQW5.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcgggcggagggaccaagttgaccgtcctaagtcagcccaaggctgccccctggtcactctgttcccaccctcctctgtcgagcgt

SEQ ID NO: 571805 - DNA, 497 bp, Homo sapiens
  misc_feature: HIJSMM301DFRX7.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctggctccaggctgaggacgaggctgattactactgctgctcatatgcaggtcgtatctcttatgtcttcggaactgggaccaaggtcaccgtcctaggtcagcccaaggccaacccactgtcactctgttcccaccctcctccacgagagta

SEQ ID NO: 571806 - DNA, 444 bp, Homo sapiens
  misc_feature: HIJSMM301DW1KH.8.73.G07.1.454.light.4.raw
  modified_base (301)..(301): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 571807 - DNA, 484 bp, Homo sapiens
  misc_feature: HIJSMM301CRAXG.52.77.G11.1.454.light.4.raw
cgcagtacgacacgaccggtgctcgatttagctagtcactcaagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcaccatctgtt

SEQ ID NO: 571808 - DNA, 499 bp, Homo sapiens
  misc_feature: HIJSMM301AUFCJ.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttggccaagggaccacgggtggaaagtacaaacgaactagtggctgcaccaatctgtcttcatt

SEQ ID NO: 571809 - DNA, 497 bp, Homo sapiens
  misc_feature: HIJSMM301AF6HQ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgccggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaggaactgtggctgcaccatctgtcttcatcttcccg

SEQ ID NO: 571810 - DNA, 475 bp, Homo sapiens; identical to SEQ ID NO: 566250
  misc_feature: HIJSMM301ETCLW.40.52.E08.1.454.light.4.raw

SEQ ID NO: 571811 - DNA, 493 bp, Homo sapiens
  misc_feature: HIJSMM301AQPSC.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggctgcaccatctgtcttcatcttcccgccat

SEQ ID NO: 571812 - DNA, 515 bp, Homo sapiens
  misc_feature: HIJSMM301AQSBX.48.11.A11.1.454.light.4.raw
agtatacatacacgaccggtgctcgatttagctacgactgcaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccgaagttgacgtcctagtacagcccaacgcgtgccccctccggtccgactctgttcccgtccctcct

SEQ ID NO: 571813 - DNA, 515 bp, Homo sapiens; identical to SEQ ID NO: 557200
  misc_feature: HIJSMM301BYUA5.14.70.G04.1.454.light.4.raw

SEQ ID NO: 571814 - DNA, 479 bp, Homo sapiens
  misc_feature: HIJSMM301BJWMK.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcacgtttcggcggagggaccgcggtggagatcagacgaactgtggctgcaccatctgtctt

SEQ ID NO: 571815 - DNA, 502 bp, Homo sapiens; identical to SEQ ID NO: 541971
  misc_feature: HIJSMM301AQWJL.4.39.D06.1.454.light.4.raw

SEQ ID NO: 571816 - DNA, 447 bp, Homo sapiens; identical to SEQ ID NO: 535201
  misc_feature: HIJSMM301BJWOK.18.9.A09.1.454.light.4.raw

SEQ ID NO: 571817 - DNA, 485 bp, Homo sapiens; identical to SEQ ID NO: 539041
  misc_feature: HIJSMM301AFZ98.46.26.C04.1.454.light.4.raw

SEQ ID NO: 571818 - DNA, 487 bp, Homo sapiens; identical to SEQ ID NO: 560173
  misc_feature: HIJSMM301A00HA.47.70.G04.1.454.light.4.raw

SEQ ID NO: 571819 - DNA, 505 bp, Homo sapiens; identical to SEQ ID NO: 539292
  misc_feature: HIJSMM301DV6W6.19.85.H08.1.454.light.4.raw

SEQ ID NO: 571820 - DNA, 489 bp, Homo sapiens; identical to SEQ ID NO: 550920
  misc_feature: HIJSMM301APJ8L.41.23.C01.1.454.light.4.raw

SEQ ID NO: 571821 - DNA, 501 bp, Homo sapiens
  misc_feature: HIJSMM301DQ20I.43.87.H10.1.454.light.4.raw
tgtgagtagtcacgaccggtgctcgatttagcagtactgcgttgggtttggggggggtcacaagaggcagtgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccac

SEQ ID NO: 571822 - DNA, 504 bp, Homo sapiens
  misc_feature: HIJSMM301ESV3E.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggaccacaaaataccagcctctctgaccattactggtctccagcctgacgacgaggctgactactactgctcagcctgggacaccagcctcgctgcttggcttttcggcggagggaccaagctgaccgtcctgggtcagccaggctgccccctcggtca

SEQ ID NO: 571823 - DNA, 507 bp, Homo sapiens; identical to SEQ ID NO: 548333
  misc_feature: HIJSMM301C0GJP.4.57.F02.1.454.light.4.raw

SEQ ID NO: 571824 - DNA, 483 bp, Homo sapiens
  misc_feature: HIJSMM301E1T3U.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgccaacaatatgattcttggccgtggacgttcggccaagggaccaacgtggaaatcaaacgaactagtggctgcaccat

SEQ ID NO: 571825 - DNA, 487 bp, Homo sapiens
  misc_feature: HIJSMM301D99VF.10.52.E08.1.454.light.4.raw
catagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaaagagccaccctctcctgcagggccagtcagagtgttaacaacaactacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtgccccgcggctcagtttcggcggagggaccaaggttgagatcaaacgaactgtggctgcaccat

SEQ ID NO: 571826 - DNA, 508 bp, Homo sapiens
  misc_feature: HIJSMM301CM5OS.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactagtggctgcaccatctgtcttcta

SEQ ID NO: 571827 - DNA, 504 bp, Homo sapiens
  misc_feature: HIJSMM301AXVBE.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggcta

SEQ ID NO: 571828 - DNA, 502 bp, Homo sapiens; identical to SEQ ID NO: 541971
  misc_feature: HIJSMM301AWPWM.4.39.D06.1.454.light.4.raw

SEQ ID NO: 571829 - DNA, 490 bp, Homo sapiens
  misc_feature: HIJSMM301ALWZZ.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaaggctggagatcaggcgtaacg

SEQ ID NO: 571830 - DNA, 523 bp, Homo sapiens
  misc_feature: HIJSMM301DFT9B.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccnccctt

SEQ ID NO: 571831 - DNA, 476 bp, Homo sapiens
  misc_feature: HIJSMM301DJYK7.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgaactgtggctgcaccatctgtcttcatcttcccgccat

SEQ ID NO: 571832 - DNA, 494 bp, Homo sapiens; identical to SEQ ID NO: 546323
  misc_feature: HIJSMM301DTGO1.51.59.F04.1.454.light.4.raw

SEQ ID NO: 571833 - DNA, 489 bp, Homo sapiens; identical to SEQ ID NO: 535139
  misc_feature: HIJSMM301BPJRB.14.55.E11.1.454.light.4.raw

SEQ ID NO: 571834 - DNA, 488 bp, Homo sapiens; identical to SEQ ID NO: 535081
  misc_feature: HIJSMM301EBYO5.26.23.C01.1.454.light.4.raw

SEQ ID NO: 571835 - DNA, 493 bp, Homo sapiens; identical to SEQ ID NO: 536769
  misc_feature: HIJSMM301CSHNR.19.83.H06.1.454.light.4.raw

SEQ ID NO: 571836 - DNA, 492 bp, Homo sapiens
  misc_feature: HIJSMM301CSSFJ.9.75.G09.1.454.light.4.raw
tgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaaggaccgaggtggaagtcaaacgaactgtggctgcaccatctgtcttcatcttccccg

SEQ ID NO: 571837 - DNA, 483 bp, Homo sapiens
  misc_feature: HIJSMM301ANYCY.48.53.E09.1.454.light.4.raw
agtatacatacacgaccggtgctcgatttagagagagtgtgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 571838 - DNA, 440 bp, Homo sapiens; identical to SEQ ID NO: 547410
  misc_feature: HIJSMM301B7IBD.11.3.A03.1.454.light.4.raw

SEQ ID NO: 571839 - DNA, 476 bp, Homo sapiens
  misc_feature: HIJSMM301BSRWW.18.9.A09.1.454.light.4.raw
  modified_base (429)..(429): a, c, t, g, unknown or other
  modified_base (437)..(437): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcccncactctctacgtgcggcggtcgtcgacgacggccgacta

SEQ ID NO: 571840 - DNA, 484 bp, Homo sapiens; identical to SEQ ID NO: 535400
  misc_feature: HIJSMM301AP4TZ.46.26.C04.1.454.light.4.raw

SEQ ID NO: 571841 - DNA, 485 bp, Homo sapiens; identical to SEQ ID NO: 536263
  misc_feature: HIJSMM301C7V32.47.78.H01.1.454.light.4.raw

SEQ ID NO: 571842 - DNA, 500 bp, Homo sapiens; identical to SEQ ID NO: 544290
  misc_feature: HIJSMM301CL8PU.48.31.C09.1.454.light.4.raw

SEQ ID NO: 571843 - DNA, 507 bp, Homo sapiens
  misc_feature: HIJSMM301AHPFG.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccgaagggaccagggtaggaaatacaaacgaactagtggctgcaccatctgtcttctatcttccccg

SEQ ID NO: 571844 - DNA, 501 bp, Homo sapiens
  misc_feature: HIJSMM301B8GJ9.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggacaagctgaccgtcctaggtcagcccaaggctgccccctcggtcgactccg

SEQ ID NO: 571845 - DNA, 494 bp, Homo sapiens; identical to SEQ ID NO: 534992
  misc_feature: HIJSMM301EGIW3.9.1.A01.1.454.light.4.raw

SEQ ID NO: 571846 - DNA, 384 bp, Homo sapiens; identical to SEQ ID NO: 540224
  misc_feature: HIJSMM301BXVN0.48.53.E09.1.454.light.4.raw

SEQ ID NO: 571847 - DNA, 488 bp, Homo sapiens
  misc_feature: HIJSMM301BOM4K.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacatacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacgaa

SEQ ID NO: 571848 - DNA, 517 bp, Homo sapiens
  misc_feature: HIJSMM301CFJK9.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtcgtcgacggacgaacgaggaagtacgaagagaacgagtggtcgtggcgaccactactcttctctactcttccgtcc

SEQ ID NO: 571849 - DNA, 484 bp, Homo sapiens; identical to SEQ ID NO: 535240
  misc_feature: HIJSMM301C8YZ0.47.60.F05.1.454.light.4.raw

SEQ ID NO: 571850 - DNA, 500 bp, Homo sapiens
  misc_feature: HIJSMM301A4BKE.48.23.C01.1.454.light.4.raw
agtatacatacacgaccggtgctcgatttagtacacgtgattagggattggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 571851 - DNA, 484 bp, Homo sapiens; identical to SEQ ID NO: 535211
  misc_feature: HIJSMM301EMQHK.47.46.E02.1.454.light.4.raw

SEQ ID NO: 571852 - DNA, 474 bp, Homo sapiens
  misc_feature: HIJSMM301DXSMC.52.2.A02.1.454.light.4.raw
cgcagtacgacacgaccggtgctcgatttagactcatctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccgaaggtggagatcagacgaaactgtgg

SEQ ID NO: 571853 - DNA, 512 bp, Homo sapiens
  misc_feature: HIJSMM301BKFS2.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctacctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcactcttcccgt

SEQ ID NO: 571854 - DNA, 504 bp, Homo sapiens; identical to SEQ ID NO: 535077
  misc_feature: HIJSMM301AWNBH.8.28.C06.1.454.light.4.raw

SEQ ID NO: 571855 - DNA, 475 bp, Homo sapiens
  misc_feature: HIJSMM301C2B4E.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaacgggacacgactcggagattaaacgaa

SEQ ID NO: 571856 - DNA, 489 bp, Homo sapiens; identical to SEQ ID NO: 543840
  misc_feature: HIJSMM301C9VGA.12.88.H11.1.454.light.4.raw

SEQ ID NO: 571857 - DNA, 466 bp, Homo sapiens
  misc_feature: HIJSMM301CED3X.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaatcgaa

SEQ ID NO: 571858 - DNA, 518 bp, Homo sapiens
  misc_feature: HIJSMM301AYK6N.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctggggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcct

SEQ ID NO: 571859 - DNA, 496 bp, Homo sapiens; identical to SEQ ID NO: 537925
  misc_feature: HIJSMM301CQWKR.22.14.B03.1.454.light.4.raw

SEQ ID NO: 571860 - DNA, 440 bp, Homo sapiens
  misc_feature: HIJSMM301E0501.18.5.A05.1.454.light.4.raw
tacgagtatgcacgaccggtgctcgatttagatagatagacagggtggaaggagactgggacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaactgtggctgcaccatctgtcttcatcttcccgccatctgacatactcgta

SEQ ID NO: 571861 - DNA, 496 bp, Homo sapiens; identical to SEQ ID NO: 565851
  misc_feature: HIJSMM301CX440.26.72.G06.1.454.light.4.raw

SEQ ID NO: 571862 - DNA, 483 bp, Homo sapiens
  misc_feature: HIJSMM301C5XGM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttattactgccaacagtatcatcatcattgtaatttcggtggagggaccaaggtggaggtcaaacgaactgtggctgcaccatctgtctt

SEQ ID NO: 571863 - DNA, 523 bp, Homo sapiens
  misc_feature: HIJSMM301CYCGD.27.23.C01.1.454.light.4.raw
  modified_base (520)..(520): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgtatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctcgttcccncct

SEQ ID NO: 571864 - DNA, 495 bp, Homo sapiens
  misc_feature: HIJSMM301B8VKQ.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcgcgggaccgacggtacggagtagtcacgacgaacgtacgtggcgtgcaccactctcg

SEQ ID NO: 571865 - DNA, 480 bp, Homo sapiens; identical to SEQ ID NO: 535442
  misc_feature: HIJSMM301DYTK4.41.17.B06.1.454.light.4.raw

SEQ ID NO: 571866 - DNA, 490 bp, Homo sapiens; identical to SEQ ID NO: 541141
  misc_feature: HIJSMM301EM3BY.47.38.D05.1.454.light.4.raw

SEQ ID NO: 571867 - DNA, 486 bp, Homo sapiens; identical to SEQ ID NO: 535043
  misc_feature: HIJSMM301CUJLF.46.35.D02.1.454.light.4.raw

SEQ ID NO: 571868 - DNA, 488 bp, Homo sapiens
  misc_feature: HIJSMM301C0UPP.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggacccaagcctggagatcacaggaactgtggctgcacc

SEQ ID NO: 571869 - DNA, 497 bp, Homo sapiens
  misc_feature: HIJSMM301CJWOE.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtcggtccaagggaccgaaggtggaaagtcaaacgaactagtggcgtgcgaccactctgtt

SEQ ID NO: 571870 - DNA, 506 bp, Homo sapiens; identical to SEQ ID NO: 557726
  misc_feature: HIJSMM301BPX68.47.83.H06.1.454.light.4.raw

SEQ ID NO: 571871 - DNA, 500 bp, Homo sapiens
  misc_feature: HIJSMM301DUXMO.49.55.E11.1.454.light.4.raw
agtcgagagacacgaccggtgctcgatttagcactcgcacgttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggcggagggaccaggctgaccgtcctggtcagccaaggctgccccctcggtcactctcg

SEQ ID NO: 571872 - DNA, 497 bp, Homo sapiens
  misc_feature: HIJSMM301CF4C4.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaaacgaactgtggctgcacc

SEQ ID NO: 571873 - DNA, 485 bp, Homo sapiens
  misc_feature: HIJSMM301ETDXZ.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaaggacacgactggagattaaacgtaaactgtggctgcaccatct

SEQ ID NO: 571874 - DNA, 488 bp, Homo sapiens; identical to SEQ ID NO: 535990
  misc_feature: HIJSMM301A0A7V.11.28.C06.1.454.light.4.raw

SEQ ID NO: 571875 - DNA, 486 bp, Homo sapiens; identical to SEQ ID NO: 535043
  misc_feature: HIJSMM301BQ0AQ.46.35.D02.1.454.light.4.raw

SEQ ID NO: 571876 - DNA, 440 bp, Homo sapiens; identical to SEQ ID NO: 539180
  misc_feature: HIJSMM301D67PB.11.3.A03.1.454.light.4.raw

SEQ ID NO: 571877 - DNA, 491 bp, Homo sapiens
  misc_feature: HIJSMM301C5VAD.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcggcccagggaccacagtggatatcaggcgaactgtggctgcaccatctgtctt

SEQ ID NO: 571878 - DNA, 496 bp, Homo sapiens
  misc_feature: HIJSMM301AZPDH.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcta

SEQ ID NO: 571879 - DNA, 486 bp, Homo sapiens
  misc_feature: HIJSMM301ANG3O.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactagtggctgca

SEQ ID NO: 571880 - DNA, 515 bp, Homo sapiens; identical to SEQ ID NO: 564475
  misc_feature: HIJSMM301EZVJ2.15.86.H09.1.454.light.4.raw

SEQ ID NO: 571881 - DNA, 478 bp, Homo sapiens
  misc_feature: HIJSMM301DN7K5.16.86.H09.1.454.light.4.raw
tgtactactccacgaccggtgctcgatttagtgctatagacttgggtttggggggggtcccaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgagtagtaca

SEQ ID NO: 571882 - DNA, 494 bp, Homo sapiens; identical to SEQ ID NO: 534994
  misc_feature: HIJSMM301B5MPT.27.78.H01.1.454.light.4.raw

SEQ ID NO: 571883 - DNA, 487 bp, Homo sapiens
  misc_feature: HIJSMM301CTINF.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcacat

SEQ ID NO: 571884 - DNA, 492 bp, Homo sapiens; identical to SEQ ID NO: 537666
  misc_feature: HIJSMM301DWKHG.43.33.C11.1.454.light.4.raw

SEQ ID NO: 571885 - DNA, 490 bp, Homo sapiens
  misc_feature: HIJSMM301AYCK1.43.20.B09.1.454.light.4.raw
tgtgagtagtcacgaccggtgctcgatttagtgtagtgtgaaggggagagaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtt

SEQ ID NO: 571886 - DNA, 520 bp, Homo sapiens
  misc_feature: HIJSMM301BV9JR.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtgttcggcggagggaccaggctgaccgtcctaggtcagcccaaggcctgccccctcggtcactctgttcccacct

SEQ ID NO: 571887 - DNA, 486 bp, Homo sapiens
  misc_feature: HIJSMM301EKUXU.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcccctactactcgtactcgagcgggccggtcgtcgaacggacggccgacaagt

SEQ ID NO: 571888 - DNA, 493 bp, Homo sapiens; identical to SEQ ID NO: 536289
  misc_feature: HIJSMM301CUUSZ.14.5.A05.1.454.light.4.raw

SEQ ID NO: 571889 - DNA, 506 bp, Homo sapiens
  misc_feature: HIJSMM301CVAKY.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatgggcagtggcgtttgggtgttcggcggagggaccaagctgaccgttcg

SEQ ID NO: 571890 - DNA, 520 bp, Homo sapiens
  misc_feature: HIJSMM301EN7HB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaagctgccccctcggtcactctgttcccaccct

SEQ ID NO: 571891 - DNA, 521 bp, Homo sapiens
  misc_feature: HIJSMM301AVHCG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccgaagctgccccctcggtcactctgttcccgccct

SEQ ID NO: 571892 - DNA, 477 bp, Homo sapiens; identical to SEQ ID NO: 542993
  misc_feature: HIJSMM301A4OYF.49.27.C05.1.454.light.4.raw

SEQ ID NO: 571893 - DNA, 517 bp, Homo sapiens
  misc_feature: HIJSMM301BITUQ.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtcccgtggacgttcggccaagggaccaaggtggcaatcaaccgaactgtggctgcaccatctgtcttcatcttcccgccta

SEQ ID NO: 571894 - DNA, 512 bp, Homo sapiens
  misc_feature: HIJSMM301CWPAG.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaatacggcctccctaaccatctctgggctccagtttgaggacgagtctacttattactgcagttcctttaaattaggcgccactctcgtggttttcggcggaggcaccgaagtgaccgtcctcggtcagcccaaggctgccccctggtcact

SEQ ID NO: 571895 - DNA, 495 bp, Homo sapiens; identical to SEQ ID NO: 553683
  misc_feature: HIJSMM301DPBWT.48.1.A01.1.454.light.4.raw

SEQ ID NO: 571896 - DNA, 498 bp, Homo sapiens; identical to SEQ ID NO: 537020
  misc_feature: HIJSMM301DCC0M.26.26.C04.1.454.light.4.raw

SEQ ID NO: 571897 - DNA, 493 bp, Homo sapiens; identical to SEQ ID NO: 537281
  misc_feature: HIJSMM301DEA0F.9.1.A01.1.454.light.4.raw

SEQ ID NO: 571898 - DNA, 472 bp, Homo sapiens; identical to SEQ ID NO: 537757
  misc_feature: HIJSMM301D1FZY.51.78.H01.1.454.light.4.raw

SEQ ID NO: 571899 - DNA, 497 bp, Homo sapiens
  misc_feature: HIJSMM301A1D59.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaacccactcgt

SEQ ID NO: 571900 - DNA, 453 bp, Homo sapiens
  misc_feature: HIJSMM301A4HUK.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagata

SEQ ID NO: 571901 - DNA, 512 bp, Homo sapiens; identical to SEQ ID NO: 552719
  misc_feature: HIJSMM301DVNJN.22.36.D03.1.454.light.4.raw

SEQ ID NO: 571902 - DNA, 486 bp, Homo sapiens; identical to SEQ ID NO: 539938
  misc_feature: HIJSMM301CIAHJ.15.1.A01.1.454.light.4.raw

SEQ ID NO: 571903 - DNA, 497 bp, Homo sapiens
  misc_feature: HIJSMM301AO1CL.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagcttgtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 571904 - DNA, 486 bp, Homo sapiens
  misc_feature: HIJSMM301AU24A.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactagtggctgcacc

SEQ ID NO: 571905 - DNA, 499 bp, Homo sapiens
  misc_feature: HIJSMM301DNW4X.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaacccca

SEQ ID NO: 571906 - DNA, 503 bp, Homo sapiens
  misc_feature: HIJSMM301EQPST.5.86.H09.1.454.light.4.raw
  modified_base (490)..(490): a, c, t, g, unknown or other
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcgagggaccaagctgaccgtcctaggtcagcccaaggccnccgcccgtcgact

SEQ ID NO: 571907 - DNA, 495 bp, Homo sapiens
  misc_feature: HIJSMM301BCCYT.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggaggatcaaacgaactgtggctgcaccatctgtcttc

SEQ ID NO: 571908 - DNA, 496 bp, Homo sapiens; identical to SEQ ID NO: 535541
  misc_feature: HIJSMM301EIT9B.3.33.C11.1.454.light.4.raw

SEQ ID NO: 571909 - DNA, 504 bp, Homo sapiens; identical to SEQ ID NO: 535128
  misc_feature: HIJSMM301CFRH8.19.85.H08.1.454.light.4.raw

SEQ ID NO: 571910 - DNA, 504 bp, Homo sapiens
  misc_feature: HIJSMM301DKKC8.41.35.D02.1.454.light.4.raw
tctatactatcacgaccggtgctcgatttagcacacgatagttgggtttgggggtgctcgattagtatctgatagttgggtttggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggaccaaggttgagatcaaacgtaacg

SEQ ID NO: 571911 - DNA, 497 bp, Homo sapiens; identical to SEQ ID NO: 535740
  misc_feature: HIJSMM301BLR7E.3.71.G05.1.454.light.4.raw

SEQ ID NO: 571912 - DNA, 488 bp, Homo sapiens; identical to SEQ ID NO: 539884
  misc_feature: HIJSMM301AMMKN.7.85.H08.1.454.light.4.raw

SEQ ID NO: 571913 - DNA, 521 bp, Homo sapiens
  misc_feature: HIJSMM301AZWZW.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttccggcccgtcgggaccgaaacgtaggtagtatactaaacgaactagtggtcgtgcaccactctgtcttt

SEQ ID NO: 571914 - DNA, 474 bp, Homo sapiens; identical to SEQ ID NO: 546420
  misc_feature: HIJSMM301BONTP.5.12.B01.1.454.light.4.raw

SEQ ID NO: 571915 - DNA, 487 bp, Homo sapiens; identical to SEQ ID NO: 536206
  misc_feature: HIJSMM301AQ4GA.47.38.D05.1.454.light.4.raw

SEQ ID NO: 571916 - DNA, 490 bp, Homo sapiens; identical to SEQ ID NO: 541244
  misc_feature: HIJSMM301C5AVW.41.44.D11.1.454.light.4.raw

SEQ ID NO: 571917 - DNA, 514 bp, Homo sapiens
  misc_feature: HIJSMM301A1US1.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaagggacccgggtaggaaagtaaaacgaactagtggctgcaccatctgtcttcatt
